(12) United States Patent
Morin et al.

(10) Patent No.: US 9,434,778 B2
(45) Date of Patent: Sep. 6, 2016

(54) MODIFIED FGF-21 POLYPEPTIDES COMPRISING AN INTERNAL DELETION AND USES THEREOF

(71) Applicant: BRISTOL-MYERS SQUIBB COMPANY, Princeton, NJ (US)

(72) Inventors: Paul E. Morin, Pennington, NJ (US); Daniel Cohen, New York, NY (US); Ranjan Mukherjee, Churchville, PA (US); Timothy P. Reilly, New Hope, PA (US); Rose C. Christian, Lawrenceville, NJ (US); Dasa Lipovsek, Cambridge, MA (US); Ray Camphausen, Wayland, MA (US); John Krupinski, Flemington, NJ (US)

(73) Assignee: BRISTOL-MYERS SQUIBB COMPANY, Princeton, NJ (US)

( * ) Notice: Subject to any disclaimer, the term of this patent is extended or adjusted under 35 U.S.C. 154(b) by 0 days.

(21) Appl. No.: 14/921,796

(22) Filed: Oct. 23, 2015

(65) Prior Publication Data

US 2016/0115213 A1  Apr. 28, 2016

Related U.S. Application Data

(60) Provisional application No. 62/068,526, filed on Oct. 24, 2014, provisional application No. 62/068,534, filed on Oct. 24, 2014, provisional application No. 62/141,383, filed on Apr. 1, 2015, provisional application No. 62/068,514, filed on Oct. 24, 2014, provisional application No. 62/068,523, filed on Oct. 24, 2014, provisional application No. 62/141,337, filed on Apr. 1, 2015, provisional application No. 62/068,296, filed on Oct. 24, 2014.

(51) Int. Cl.
| | |
|---|---|
| *A61K 38/18* | (2006.01) |
| *A61K 39/395* | (2006.01) |
| *C07K 14/50* | (2006.01) |
| *A61K 45/06* | (2006.01) |
| *A61K 47/48* | (2006.01) |
| *A61K 38/00* | (2006.01) |

(52) U.S. Cl.
CPC .......... *C07K 14/50* (2013.01); *A61K 38/1825* (2013.01); *A61K 45/06* (2013.01); *A61K 47/48* (2013.01); *A61K 38/00* (2013.01); *C07K 2319/00* (2013.01); *C07K 2319/30* (2013.01)

(58) Field of Classification Search
None
See application file for complete search history.

(56) References Cited

U.S. PATENT DOCUMENTS

| | | |
|---|---|---|
| 2,968,158 A | 1/1961 | Ruschig et al. |
| 3,097,242 A | 7/1963 | Hoehn et al. |
| 3,454,635 A | 7/1969 | Weber et al. |
| 3,501,495 A | 3/1970 | Beregi et al. |
| 3,654,357 A | 4/1972 | Bretschneider et al. |
| 3,668,215 A | 6/1972 | Plumpe et al. |
| 3,669,966 A | 6/1972 | Ambrogi et al. |
| 3,708,486 A | 1/1973 | Kutter et al. |
| 3,773,919 A | 11/1973 | Boswell et al. |
| 4,287,200 A | 9/1981 | Kawamatsu et al. |
| 4,289,872 A | 9/1981 | Denkewalter et al. |
| 4,412,989 A | 11/1983 | Iwashita et al. |
| 4,414,148 A | 11/1983 | Jansen et al. |
| 4,452,747 A | 6/1984 | Gersonde |
| 4,485,045 A | 11/1984 | Regen |
| 4,511,502 A | 4/1985 | Builder et al. |
| 4,511,503 A | 4/1985 | Olson et al. |
| 4,512,922 A | 4/1985 | Jones et al. |
| 4,544,545 A | 10/1985 | Ryan et al. |
| 4,551,433 A | 11/1985 | Deboer |
| 4,569,789 A | 2/1986 | Blattler et al. |
| 4,572,912 A | 2/1986 | Yoshioku et al. |
| 4,619,794 A | 10/1986 | Hauser |
| 4,659,839 A | 4/1987 | Nicolotti et al. |
| 4,670,417 A | 6/1987 | Iwasaki et al. |
| 4,671,958 A | 6/1987 | Rodwell et al. |
| 4,680,338 A | 7/1987 | Sundoro |
| 4,687,777 A | 8/1987 | Meguro |
| 4,689,406 A | 8/1987 | Banks et al. |
| 4,699,784 A | 10/1987 | Shih et al. |
| 4,738,921 A | 4/1988 | Belagaje et al. |
| 4,755,465 A | 7/1988 | Gray et al. |
| 4,820,352 A | 4/1989 | Riedhammer |
| 4,837,148 A | 6/1989 | Cregg |
| 4,859,600 A | 8/1989 | Gray et al. |
| 4,873,080 A | 10/1989 | Brickl et al. |

(Continued)

FOREIGN PATENT DOCUMENTS

| | | |
|---|---|---|
| AU | 1740283 | 2/1984 |
| CA | 2386517 | 4/2001 |
| CN | 1914223 A | 2/2007 |
| DE | 3218121 | 11/1983 |
| EP | 036 676 | 9/1981 |
| EP | 036 776 | 9/1981 |
| EP | 052 322 | 5/1982 |
| EP | 058 481 | 8/1982 |
| EP | 073 657 | 3/1983 |
| EP | 102 324 | 3/1984 |

(Continued)

OTHER PUBLICATIONS

Switzer, C. et al., "Enzymatic incorporation of a new base pair into DNA and RNA", J. Am. Chem. Soc., 1989, 111(21): 8322-8323.

(Continued)

*Primary Examiner* — Christine J Saoud
(74) *Attorney, Agent, or Firm* — LeClairRyan, a professional corporation; Robin L. Teskin

(57) ABSTRACT

Modified FGF-21 polypeptides and uses thereof are provided, for example, for the treatment of diseases associated with fibrosis. Modified FGF-21 polypeptides are disclosed that contain an internal deletion and optionally replacement peptide, optionally modified with at least one non-naturally-encoded amino acid, and/or optionally fused to a fusion partner.

20 Claims, 81 Drawing Sheets

(56) References Cited

U.S. PATENT DOCUMENTS

| | | |
|---|---|---|
| 4,873,255 A | 10/1989 | Yoshioka et al. |
| 4,876,197 A | 10/1989 | Burke et al. |
| 4,880,734 A | 11/1989 | Burke et al. |
| 4,897,405 A | 1/1990 | Alessi et al. |
| 4,902,502 A | 2/1990 | Nitecki et al. |
| 4,904,584 A | 2/1990 | Shaw |
| 4,929,555 A | 5/1990 | Cregg et al. |
| 5,002,953 A | 3/1991 | Hindley |
| 5,021,234 A | 6/1991 | Ehrenfeld |
| 5,061,717 A | 10/1991 | Clark et al. |
| 5,089,398 A | 2/1992 | Rosenberg et al. |
| 5,120,754 A | 6/1992 | Clark et al. |
| 5,122,614 A | 6/1992 | Zalipsky |
| 5,132,317 A | 7/1992 | Cantello et al. |
| 5,162,601 A | 11/1992 | Slightom |
| 5,218,092 A | 6/1993 | Sasaki et al. |
| 5,219,564 A | 6/1993 | Zalipsky et al. |
| 5,223,522 A | 6/1993 | Clark et al. |
| 5,229,490 A | 7/1993 | Tam |
| 5,231,178 A | 7/1993 | Holtz et al. |
| 5,252,714 A | 10/1993 | Harris et al. |
| 5,258,185 A | 11/1993 | Bauer et al. |
| 5,281,698 A | 1/1994 | Nitecki |
| 5,290,686 A | 3/1994 | Kendal et al. |
| 5,324,639 A | 6/1994 | Brierley et al. |
| 5,324,844 A | 6/1994 | Zalipsky |
| 5,382,657 A | 1/1995 | Karasiewicz et al. |
| 5,446,090 A | 8/1995 | Harris |
| 5,468,478 A | 11/1995 | Saifer et al. |
| 5,473,034 A | 12/1995 | Yasui et al. |
| 5,476,653 A | 12/1995 | Pitt et al. |
| 5,516,657 A | 5/1996 | Murphy et al. |
| 5,516,673 A | 5/1996 | Margel et al. |
| 5,532,142 A | 7/1996 | Johnston et al. |
| 5,559,213 A | 9/1996 | Hakimi et al. |
| 5,571,709 A | 11/1996 | Devauchelle et al. |
| 5,580,723 A | 12/1996 | Wells et al. |
| 5,583,023 A | 12/1996 | Cerutti et al. |
| 5,602,034 A | 2/1997 | Tekamp-Olson |
| 5,605,827 A | 2/1997 | Jackwood et al. |
| 5,612,460 A | 3/1997 | Zalipsky |
| 5,614,492 A | 3/1997 | Habener |
| 5,629,203 A | 5/1997 | Shuster |
| 5,629,384 A | 5/1997 | Veronese et al. |
| 5,643,575 A | 7/1997 | Martinez et al. |
| 5,650,234 A | 7/1997 | Dolence et al. |
| 5,672,662 A | 9/1997 | Harris et al. |
| 5,674,706 A | 10/1997 | Shuster |
| RE35,749 E | 3/1998 | Rosenberg et al. |
| 5,736,625 A | 4/1998 | Callstrom et al. |
| 5,739,208 A | 4/1998 | Harris |
| 5,747,646 A | 5/1998 | Hakimi et al. |
| 5,750,373 A | 5/1998 | Garrard et al. |
| 5,753,220 A | 5/1998 | Suzuki et al. |
| 5,762,939 A | 6/1998 | Smith et al. |
| 5,766,883 A | 6/1998 | Ballance et al. |
| 5,766,885 A | 6/1998 | Carrington et al. |
| 5,808,096 A | 9/1998 | Zalipsky |
| 5,824,778 A | 10/1998 | Ishikawa et al. |
| 5,824,784 A | 10/1998 | Kinstler et al. |
| 5,834,250 A | 11/1998 | Wells et al. |
| 5,834,594 A | 11/1998 | Hakimi et al. |
| 5,843,733 A | 12/1998 | Estes |
| 5,849,860 A | 12/1998 | Hakimi et al. |
| 5,858,368 A | 1/1999 | Smith et al. |
| 5,859,037 A | 1/1999 | Whitcomb |
| 5,861,279 A | 1/1999 | Zhang et al. |
| 5,871,986 A | 2/1999 | Boyce |
| 5,874,454 A | 2/1999 | Antonucci et al. |
| 5,876,969 A | 3/1999 | Fleer et al. |
| 5,880,270 A | 3/1999 | Berninger et al. |
| 5,891,676 A | 4/1999 | Estes |
| 5,900,461 A | 5/1999 | Harris |
| 5,932,462 A | 8/1999 | Harris et al. |
| 5,939,285 A | 8/1999 | Devauchelle et al. |
| 5,965,393 A | 10/1999 | Hasnain et al. |
| 5,980,948 A | 11/1999 | Goedemoed et al. |
| 5,989,868 A | 11/1999 | Harrison et al. |
| 5,990,237 A | 11/1999 | Bentley et al. |
| 6,001,800 A | 12/1999 | Mehta et al. |
| 6,004,573 A | 12/1999 | Rathi et al. |
| 6,013,433 A | 1/2000 | Pellett et al. |
| 6,013,478 A | 1/2000 | Wells et al. |
| 6,017,731 A | 1/2000 | Tekamp-Olson et al. |
| 6,083,723 A | 7/2000 | Tekamp-Olson |
| 6,096,304 A | 8/2000 | McCutchen |
| 6,126,944 A | 10/2000 | Pellett et al. |
| 6,129,912 A | 10/2000 | Hortin et al. |
| 6,168,932 B1 | 1/2001 | Uckun et al. |
| 6,183,985 B1 | 2/2001 | Shuster |
| 6,183,987 B1 | 2/2001 | Van de Wiel et al. |
| 6,184,344 B1 | 2/2001 | Kent et al. |
| 6,201,072 B1 | 3/2001 | Rathi et al. |
| 6,214,966 B1 | 4/2001 | Harris |
| 6,225,060 B1 | 5/2001 | Clark et al. |
| 6,235,710 B1 | 5/2001 | Mehta et al. |
| 6,245,528 B1 | 6/2001 | Chao |
| 6,261,805 B1 | 7/2001 | Wood |
| RE37,343 E | 8/2001 | Tekamp-Olson |
| 6,281,211 B1 | 8/2001 | Cai et al. |
| 6,306,821 B1 | 10/2001 | Mikos et al. |
| 6,312,923 B1 | 11/2001 | Tekamp-Olson |
| 6,337,191 B1 | 1/2002 | Swartz et al. |
| 6,338,846 B1 | 1/2002 | Kang et al. |
| 6,342,216 B1 | 1/2002 | Fidler et al. |
| 6,361,969 B1 | 3/2002 | Galeotti |
| 6,368,825 B1 | 4/2002 | Chao |
| 6,420,339 B1 | 7/2002 | Gegg et al. |
| 6,423,685 B1 | 7/2002 | Drummond et al. |
| 6,428,954 B1 | 8/2002 | Wells et al. |
| 6,436,386 B1 | 8/2002 | Roberts et al. |
| 6,451,346 B1 | 9/2002 | Shah et al. |
| 6,451,561 B1 | 9/2002 | Wells et al. |
| 6,461,603 B2 | 10/2002 | Bentley et al. |
| 6,515,100 B2 | 2/2003 | Harris |
| 6,521,427 B1 | 2/2003 | Evans |
| 6,552,167 B1 | 4/2003 | Rose |
| 6,586,207 B2 | 7/2003 | Tirrell et al. |
| 6,602,498 B2 | 8/2003 | Shen |
| 6,608,183 B1 | 8/2003 | Cox |
| 6,610,281 B2 | 8/2003 | Harris |
| 6,646,110 B2 | 11/2003 | Nissen et al. |
| 6,716,626 B1 | 4/2004 | Itoh et al. |
| 6,852,502 B1 | 2/2005 | Martin |
| 6,927,042 B2 | 8/2005 | Schultz et al. |
| 7,045,337 B2 | 5/2006 | Schultz et al. |
| 7,083,970 B2 | 8/2006 | Schultz et al. |
| 7,259,248 B2 | 8/2007 | Itoh et al. |
| 7,408,047 B1 | 8/2008 | Thomason et al. |
| 7,459,540 B1 | 12/2008 | Thomason et al. |
| 7,576,190 B2 | 8/2009 | Glaesner et al. |
| 7,582,607 B2 | 9/2009 | Frye et al. |
| 7,622,445 B2 | 11/2009 | Frye et al. |
| 7,655,627 B2 | 2/2010 | Frye et al. |
| 7,667,008 B2 | 2/2010 | Thomason et al. |
| 7,846,445 B2 | 12/2010 | Schellenberger et al. |
| 8,012,931 B2 | 9/2011 | Cujec et al. |
| 8,361,963 B2 | 1/2013 | Belouski et al. |
| 8,383,365 B2 | 2/2013 | Cujec et al. |
| 8,410,051 B2 | 4/2013 | Belouski et al. |
| 9,006,400 B2 | 4/2015 | Boettcher et al. |
| 9,023,791 B2 | 5/2015 | Boettcher et al. |
| 9,079,971 B2 | 7/2015 | Cujec et al. |
| 2001/0012628 A1 | 8/2001 | Agarwal et al. |
| 2001/0021763 A1 | 9/2001 | Harris |
| 2001/0044526 A1 | 11/2001 | Shen |
| 2001/0056171 A1 | 12/2001 | Kozlowski |
| 2002/0002250 A1 | 1/2002 | Bentley et al. |
| 2002/0037949 A1 | 3/2002 | Harris et al. |
| 2002/0040076 A1 | 4/2002 | Harris et al. |
| 2002/0042097 A1 | 4/2002 | Tirrell |
| 2002/0052009 A1 | 5/2002 | Hornauer et al. |
| 2002/0052430 A1 | 5/2002 | Harris |
| 2002/0055169 A1 | 5/2002 | Tekamp-Olson |

(56) References Cited

U.S. PATENT DOCUMENTS

| | | |
|---|---|---|
| 2002/0072573 A1 | 6/2002 | Bentley et al. |
| 2002/0081660 A1 | 6/2002 | Swartz et al. |
| 2002/0082345 A1 | 6/2002 | Kozlowski et al. |
| 2002/0086939 A1 | 7/2002 | Kozlowski |
| 2002/0099133 A1 | 7/2002 | Kozlowski |
| 2002/0156047 A1 | 10/2002 | Zhao |
| 2002/0164713 A1 | 11/2002 | Itoh et al. |
| 2003/0023023 A1 | 1/2003 | Harris et al. |
| 2003/0082575 A1 | 5/2003 | Schultz et al. |
| 2003/0105224 A1 | 6/2003 | Roberts et al. |
| 2003/0105275 A1 | 6/2003 | Bentley et al. |
| 2003/0108885 A1 | 6/2003 | Schultz et al. |
| 2003/0114647 A1 | 6/2003 | Harris et al. |
| 2003/0143596 A1 | 7/2003 | Bentley et al. |
| 2003/0158333 A1 | 8/2003 | Roberts |
| 2003/0162949 A1 | 8/2003 | Cox |
| 2003/0208046 A1 | 11/2003 | Hunter et al. |
| 2003/0220447 A1 | 11/2003 | Harris |
| 2003/0228274 A1 | 12/2003 | Rose |
| 2003/0228593 A1 | 12/2003 | Suga et al. |
| 2004/0001838 A1 | 1/2004 | Zhao et al. |
| 2004/0013637 A1 | 1/2004 | Bentley |
| 2004/0115774 A1 | 6/2004 | Kochendoerfer et al. |
| 2004/0138412 A1 | 7/2004 | Botti et al. |
| 2004/0185494 A1 | 9/2004 | Itoh et al. |
| 2004/0198637 A1 | 10/2004 | Schultz et al. |
| 2004/0259780 A1 | 12/2004 | Glasebrook et al. |
| 2005/0009049 A1 | 1/2005 | Chin et al. |
| 2005/0037457 A1 | 2/2005 | Itoh et al. |
| 2005/0085619 A1 | 4/2005 | Wilson et al. |
| 2005/0170404 A1 | 8/2005 | Cho et al. |
| 2005/0176631 A1 | 8/2005 | Heuer et al. |
| 2005/0208522 A1 | 9/2005 | Jing et al. |
| 2005/0220762 A1 | 10/2005 | Cho et al. |
| 2005/0245571 A1 | 11/2005 | Abe et al. |
| 2006/0194256 A1 | 8/2006 | Miao et al. |
| 2006/0217289 A1 | 9/2006 | Miao et al. |
| 2006/0217532 A1 | 9/2006 | Miao et al. |
| 2007/0293430 A1 | 12/2007 | Frye et al. |
| 2008/0255045 A1 | 10/2008 | Cujec et al. |
| 2008/0261875 A1 | 10/2008 | Etgen |
| 2010/0216715 A1 | 8/2010 | Tagmose et al. |
| 2011/0172401 A1 | 7/2011 | Cujec et al. |
| 2011/0195895 A1 | 8/2011 | Walker et al. |
| 2011/0305663 A1 | 12/2011 | Gosselin et al. |
| 2012/0129766 A1 | 5/2012 | Boettcher et al. |
| 2012/0220011 A1 | 8/2012 | Schellenberger et al. |
| 2013/0150564 A1 | 6/2013 | Cujec et al. |
| 2013/0252884 A1 | 9/2013 | Garibay et al. |
| 2014/0073563 A1 | 3/2014 | Boscheinen et al. |
| 2015/0273075 A1 | 10/2015 | Cujec et al. |

FOREIGN PATENT DOCUMENTS

| | | |
|---|---|---|
| EP | 121 775 | 10/1984 |
| EP | 127 839 | 12/1984 |
| EP | 133 988 | 3/1985 |
| EP | 143 949 | 6/1985 |
| EP | 154 316 | 9/1985 |
| EP | 155 476 | 9/1985 |
| EP | 164 556 | 12/1985 |
| EP | 183 503 | 6/1986 |
| EP | 188 256 | 7/1986 |
| EP | 229 108 | 7/1987 |
| EP | 244 234 | 11/1987 |
| EP | 267 851 | 5/1988 |
| EP | 284 044 | 9/1988 |
| EP | 324 274 | 7/1989 |
| EP | 329 203 | 8/1989 |
| EP | 340 986 | 11/1989 |
| EP | 400 472 | 12/1990 |
| EP | 402 378 | 12/1990 |
| EP | 439 508 | 8/1991 |
| EP | 480 480 | 4/1992 |
| EP | 510 356 | 10/1992 |
| EP | 605 963 | 7/1994 |
| EP | 732 403 | 9/1996 |
| EP | 809 996 | 12/1997 |
| EP | 921 131 | 6/1999 |
| EP | 946 736 | 10/1999 |
| JP | 60-007934 | 1/1985 |
| JP | 2007-519420 A | 7/2007 |
| JP | 2007-531715 A | 11/2007 |
| WO | 88/07082 | 9/1988 |
| WO | 89/01037 | 2/1989 |
| WO | 89/01038 | 2/1989 |
| WO | 90/01556 | 2/1990 |
| WO | 90/02186 | 3/1990 |
| WO | 90/02566 | 3/1990 |
| WO | 90/05785 | 5/1990 |
| WO | 90/10078 | 9/1990 |
| WO | 90/10277 | 9/1990 |
| WO | 90/13540 | 11/1990 |
| WO | 90/14428 | 11/1990 |
| WO | 91/00357 | 1/1991 |
| WO | 92/01801 | 2/1992 |
| WO | 92/02628 | 2/1992 |
| WO | 92/16555 | 10/1992 |
| WO | 92/16619 | 10/1992 |
| WO | 93/03173 | 2/1993 |
| WO | 93/15189 | 8/1993 |
| WO | 93/21259 | 10/1993 |
| WO | 94/04193 | 3/1994 |
| WO | 94/09027 | 4/1994 |
| WO | 94/14758 | 7/1994 |
| WO | 94/15625 | 7/1994 |
| WO | 94/17039 | 8/1994 |
| WO | 94/18247 | 8/1994 |
| WO | 94/28024 | 12/1994 |
| WO | 95/00162 | 1/1995 |
| WO | 95/06058 | 3/1995 |
| WO | 95/11924 | 5/1995 |
| WO | 95/13090 | 5/1995 |
| WO | 95/13312 | 5/1995 |
| WO | 95/20672 | 8/1995 |
| WO | 95/33490 | 12/1995 |
| WO | 96/00080 | 1/1996 |
| WO | 96/06161 | 2/1996 |
| WO | 96/07670 | 3/1996 |
| WO | 96/21469 | 7/1996 |
| WO | 96/25496 | 8/1996 |
| WO | 96/29400 | 9/1996 |
| WO | 96/40791 | 12/1996 |
| WO | 96/41813 | 12/1996 |
| WO | 97/03106 | 1/1997 |
| WO | 97/18832 | 5/1997 |
| WO | 97/24445 | 7/1997 |
| WO | 97/26332 | 7/1997 |
| WO | 97/32607 | 9/1997 |
| WO | 98/05363 | 2/1998 |
| WO | 98/26080 | 6/1998 |
| WO | 98/32466 | 7/1998 |
| WO | 98/37208 | 8/1998 |
| WO | 98/41562 | 9/1998 |
| WO | 98/44921 | 10/1998 |
| WO | 98/45285 | 10/1998 |
| WO | 98/48837 | 11/1998 |
| WO | 99/03887 | 1/1999 |
| WO | 99/05297 | 2/1999 |
| WO | 99/07862 | 2/1999 |
| WO | 99/09193 | 2/1999 |
| WO | 99/10515 | 3/1999 |
| WO | 99/22735 | 5/1999 |
| WO | 99/31257 | 6/1999 |
| WO | 99/32134 | 7/1999 |
| WO | 99/32139 | 7/1999 |
| WO | 99/32140 | 7/1999 |
| WO | 99/45130 | 9/1999 |
| WO | 99/51721 | 10/1999 |
| WO | 99/67291 | 12/1999 |
| WO | 00/20032 | 4/2000 |
| WO | 00/26354 | 5/2000 |
| WO | 00/55345 | 9/2000 |
| WO | 00/55353 | 9/2000 |

(56) References Cited

FOREIGN PATENT DOCUMENTS

| | | |
|---|---|---|
| WO | 01/05956 | 1/2001 |
| WO | 01/18172 | 3/2001 |
| WO | 01/25228 | 4/2001 |
| WO | 01/27301 | 4/2001 |
| WO | 01/36640 | 5/2001 |
| WO | 01/38325 | 5/2001 |
| WO | 01/90390 | 11/2001 |
| WO | 02/06305 | 1/2002 |
| WO | 02/085923 | 10/2002 |
| WO | 02/086075 | 10/2002 |
| WO | 02/098902 | 12/2002 |
| WO | 03/011213 | 2/2003 |
| WO | 03/042204 | 5/2003 |
| WO | 03/042235 | 5/2003 |
| WO | 03/059270 | 7/2003 |
| WO | 03/101972 | 12/2003 |
| WO | 2004/035605 | 4/2004 |
| WO | 2004/035743 | 4/2004 |
| WO | 2004/058946 | 7/2004 |
| WO | 2004/094593 | 11/2004 |
| WO | 2004/110472 | 12/2004 |
| WO | 2005/007624 | 1/2005 |
| WO | 2005/007870 | 1/2005 |
| WO | 2005/019415 | 3/2005 |
| WO | 2005/035727 | 4/2005 |
| WO | 2005/061712 | 7/2005 |
| WO | 2005/072769 | 8/2005 |
| WO | 2005/074524 | 8/2005 |
| WO | 2005/074546 | 8/2005 |
| WO | 2005/074650 | 8/2005 |
| WO | 2005/091944 | 10/2005 |
| WO | 2005/113606 | 12/2005 |
| WO | 2006/028595 | 3/2006 |
| WO | 2006/028714 | 3/2006 |
| WO | 2006/050247 | 5/2006 |
| WO | 2006/065582 | 6/2006 |
| WO | 2006/068802 | 6/2006 |
| WO | 2006/069246 | 6/2006 |
| WO | 2006/078463 | 7/2006 |
| WO | 2007/021297 | 2/2007 |
| WO | 2007/070659 | 6/2007 |
| WO | 2007/079130 | 7/2007 |
| WO | 2008/083346 | 7/2008 |
| WO | 2008/121563 | 10/2008 |
| WO | 2008/155134 | 12/2008 |
| WO | 2009/149171 | 12/2009 |
| WO | 2010/042747 | 4/2010 |
| WO | 2011/154349 | 12/2011 |
| WO | 2012/066075 | 5/2012 |
| WO | 2012/162542 | 11/2012 |
| WO | 2013/052311 | 11/2013 |
| WO | 2013/188181 | 12/2013 |

OTHER PUBLICATIONS

Tabor, S. and Richardson, C.C., "A bacteriophage T7 RNA polymerase/promoter system for controlled exclusive expression of specific genes", Proc. Natl. Acad. Sci. USA, Feb. 1985, 82(4): 1074-8.
Tae, E.L. et al., "Efforts toward Expansion of the Genetic Alphabet: Replication of DNA with Three Base Pairs", J. Am. Chem. Soc., 2001, 123(3): 7439-7440.
Tanaka, R. et al., "Basic fibroblast growth factor increases regional cerebral blood flow and reduces infarct size after experimental ischemia in a rat model", Stroke, 1995, 26: 2154-2159.
Tanaka, A. et al., "Human androgen-induced growth factor in prostate and breast cancer cells: its molecular cloning and growth properties", FEBS Lett., 1995, 363: 226-230.
Tang, Y. et al., "Fluorinated Coiled-Coil Protiens Prepared In Vivo Display Enhanced Thermal and Chemical Stability", Angew. Chem. Int. Ed. Engl., Apr. 17, 2001, 40(8): 1494-1496.
Taylor, J.W. et al., "The rapid generation of oligonucleotide-directed mutations at high frequency using phosphorothioate-modified DNA", Nucleic Acids Res., Dec. 20, 1985, 13(24): 8765-85.

Taylor, J.W. et al., "The use of phosphorothioate-modified DNA in restriction enzyme reactions to prepare nicked DNA", Nucleic Acids Res., Dec. 20, 1985, 13(24): 8749-64.
Tijssen, P., "Overview of principles of hybridization and the strategy of nucleic acid assays", in Laboratory Techniques in Biochemistry and Molecular Biology—Hybridization with Nucleic Probes, v. 24, Part I, 1993, Elsevier Science Publishers, Amsterdam, 19-78.
Tilburn, J. et al., "Transformation by integration in Aspergillus nidulans", Gene, Dec. 1983, 26(2-3): 205-21.
Tilkins, M.L et al., "Transfection of Mammalian and Invertebrate Cells Using Cationic Lipids", Cell Biology: A Laboratory Handbook, 1998, 2nd Ed., vol. 4: 145-154.
Tondelli, L. et al., "Poly(ethylene Glycol) Imidazolyl Formates as Oligomeric Drug-Binding Matrices", J. Controlled Release 1985, 1(4): 251-257.
Tornøe, C.W. et al., "Peptidotriazoles on solid phase: [1,2,3]-triazoles by regiospecific copper(I)-catalyzed 1,3-dipolar cycloadditions of terminal alkynes to azides", J. Org. Chem., May 3, 2002, 67(9): 3057-3064.
Trotter, K.M. and Wood, H.A., "Transfection techniques for producing recombinant baculoviruses", in Methods in Molecular Biology—Baculovirus Expression Protocols, vol. 39 (1995); Ed. C.D. Richardson, 97-107.
Truett, G.E. et al., "Rat obesity gene fatty (fa) maps to chromosome 5: evidence for homology with the mouse gene liabetes (db)", PNAS USA, 1991, 88: 7806-09.
Tschumper, G. and Carbon, J., "Sequence of a yeast DNA fragment containing a chromosomal recplicator and the TRP1 gene", Gene 1980, 10(2): 157-166.
Tsumoto, K et al., "Practical considerations in refolding proteins from inclusion bodies", Protein Expr. Purif., Mar. 2003, 28(1): 1-8.
Turcatti, G. et al., "Probing the structure and function of the tachykinin neurokinin-2 receptor through biosynthetic incorporation of fluorescent amino acids at specific sites", J. Biol. Chem., Aug. 16, 1996, 271(33): 19991-8.
Uhl, E. et al., "Basic fibroblast growth factor accelerates wound healing in chronically ischaemic tissue", Br. J. Surg., 1993, 80: 977-980.
Van Den Berg, J.A. et al., "Kluyveromyces as a host for heterologous gene expression: expression and secretion of prochymosin", Biotechnology (NY), Feb. 1990, 8(2): 135-139.
Van den Berghe, G.V. et al., "Intensive insulin therapy in the critically ill patients", N. Engl. J. Med., 2001, 345(19): 1359-67.
Van Hest, J.C.M. and Tirrell, D.A., "Efficient introduction of alkene functionality into proteins in vivo", FEBS Lett. May 22, 1998, 428(1-2): 68-70.
Van Hest, J.C.M. et al., "Efficient incorporation of Unsaturated Methionine Analogues into Proteins in Vivo", J. Am. Chem. Soc., 2000, 122(7): 1282-1288.
Van Solingen, P. and van der Plaat, J.B., "Fusion of yeast spheroplasts", J. Bacteriol. May 1977, 130(2): 946-947.
Veronese, F.M. et al., "Surface modification of proteins. Activation of monomethoxy-polyethylene glycols by phenylchlorofomates and modification of ribonuclease and superoxide dismutase", Appl. Biochem. Biotechnol., Apr. 1985, 11(2): 141-152.
Vlak, J.M. et al., "Functional studies on the p10 gene of Autographa californica nuclear polyhedrosis virus using a recombinant expressing a p10-beta-galactosidase fusion gene", J. Gen. Virol., Apr. 1988, 69(Pt. 4): 765-776.
Wang, L and Shultz, P.G., "Expanding the genetic code", Chem. Commun. (Camb.), Jan. 7, 2002, 1:1-11.
Wang, L et al., "Addition of the keto functional group to the genetic code of *Escherichia coli*", Proc. Natl. Acad. Sci, 2003, 100(1): 56-61.
Wang, L. et al., "Expanding the genetic code of *Escherichia coli*", Science. Apr. 20, 2001, 292(5516): 498-500.
Wang, Q. et al., "Bioconjugation by Copper(I)-Catalyzed Azide-Alkyne [3+2] Cycloaddition", J. Am. Chem. Soc., 2003, 125(11): 3192-3193.
Wang, W., "Instability, stabilization, and formulation of liquid protein pharmaceuticals", Int. J. Pharm., Aug. 20, 1999, 185(2): 129-88.

(56) References Cited

OTHER PUBLICATIONS

Weissmann, C., "The cloning of interferon and other mistakes", in Interferon 3, 1981. Ed. I. Gresser; Academic Press, London, 101-134.
Wells, J.A. et al., "Cassette mutagenesis: an efficient method for generation of multiple mutations at defined sites", Gene. 1985, 34(2-3): 315-23.
Wells, J.A. et al., "Importance of hydrogen-bond formation in stabilizing the transition state of subtilisin", Phil. Trans. R. Soc. Lond. A 1986. 317:415-423.
Wilke, T.A. et al., "Expression of fibroblast growth factor receptors (FGFR1, FGFR2, FGFR3) in the developing head and face", Dev. Dynam., 1997, 210: 41-52.
Wilkie, A.O.M. et al., "Functions of fibroblast growth factors and their receptors", Current Biology, 1995, 5(5): 500-507.
Woghiren, C. et al., "Protected thiol-polytheylene glycol: a new activated polymer for reversible protein modification", Bioconjug. Chem., Sep.-Oct. 1993, 4(5): 314-8.
Wong, S.S. and Wong, L-J.C., "Chemical crosslinking and the stabilization of proteins and enzymes", Enzyme Microb. Technol., Nov. 1992, 14(11): 866-874.
Wright, K., "Biotechnology: Insect virus as super-vector?", Nature, 1986, 321(6072): 718.
Yelton, M.M. et al., "Transformation of Aspergillus nidulans by using a trpC plasmid", Proc. Natl. Acad. Sci. USA, Mar. 1984, 81(5): 1470-4.
Yelverton, E. et al, "Bacterial synthesis of a novel human leukocyte interferon", Nucleic Acids Res., Feb. 11, 1981, 9(3): 731-741.
Yoshida, T. et al., "Characterization of the hst-1 gene and its product", Ann. NY Acad. Sci., 1991, 638:27-37.
Zalipsky, S. et al., "Attachment of drugs to polyethylene glycols", Eur. Polymer Journal, 1983, 19(12): 1177-83.
Zalipsky, S., "Functionalized poly(ethylene glycol) for preparation of biologically relevant conjugates", Bioconjug. Chem., Mar.-Apr. 1995, 6(2): 150-165.
Zander, M. et al. "Additive glucose-lowering effects of glucagon-like peptide-1 and metformin in type 2 diabetes", Diabetes Care, 2001, 24(4): 720-5.
Zhang, Z. et al., "A new strategy for the site-specific modification of proteins in vivo", Biochemistry. Jun. 10, 2003, 42(22): 6735-46.
Zoller, M.J. and Smith, M., "Oligonucleotide-directed mutagenesis of DNA fragments cloned into M13 vectors", Methods Enzymol., 1983, 100: 468-500.
Zoller, M.J. and Smith, M., "Oligonucleotide-directed mutagenesis using M13-derived vectors: an efficient and general procedure for the producaiton of point mutations in any fragment of DNA", Nucleic Acids Res., Oct. 25, 1982, 10(20): 6487-500.
Zoller, M.J. and Smith, M., "Oligonucleotide-directed mutagenesis: a simple method using two oligonucleotide primers and a single-stranded DNA template", Methods Enzymol., 1987, 154: 329-50.
Abuchowski, A. et al., "Cancer therapy with chemically modified enzymes. I. Antitumor properties of polyethylene glycol-asparaginase conjugates", Cancer Biochem. Biophys., Jun. 1984, 7(2): 175-86.
Ahrén, B. et al., "Inhibition of dipeptidyl peptidase IV improves metabolic control over a 4-week study period in type 2 diabetes", Diabetes Care, 2002, 25(5): 869-75.
Altschul, S.F. et al., "Basic local alignment search tool", J. Mol. Biol., Oct. 5, 1990, 215(3): 403-10.
Altschul, S.F. et al., "Gapped BLAST and PSI-BLAST: a new generation of protein database search programs", Nucleic Acids Res., Sep. 1, 1997, 25(17): 3389-3402.
Amann, E. et al., "Vectors bearing a hybrid trp-lac promoter useful for regulated expression of cloned genes in *Escherichia coli*", Gene, Nov. 1983, 25(2-3): 167-78.
Anderson, J.C. et al., "Exploring the limits of codon and anticodon size", Chem. Biol., Feb. 2002, 9(2): 237-44.

Andresz, H. et al., "Chemische Synthese verzweigter Polysaccharide, 5: Kopplung von Oligosacchariden und Amylose an verschiedene Träer durch Hydrazonbindung", Makromol. Chem. 1978, 179: 301.
Arakawa et al., "Protein-solvent interactions in pharmaceutical formulations", Pharm. Res., 1991, 8(3): 285-291.
Arnold, F.H., "Protein engineering for unusual environments", Curr. Opin. Biotechnol., Aug. 1993, 4(4): 450-5.
Azoulay, M. et al., "Glutamine analogues as Potential Antimalarials", Eur. J. Med. Chem., 1991, 26(2): 201-5.
Bailey, "Biguanides and NIDDM", Diabetes Care, 1992, 15(6):755-72.
Bain, J.D. et al., "Ribosome-mediated incorporation of a non-standard amino acid into a peptide through expansion of the genetic code", Nature, 1992, 356(6369): 537-539.
Bain, J.D. et al., "Biosynthetic site-specific incorporation of a non-natural amino acid into a polypeptide", J. Am. Chem. Soc., 1989; 111(20): 8013-8014.
Baird, A. and Klagsbum, M., "The fibroblast growth factor family", Cancer Cells, 1991, 3(6): 239-43.
Ballance, D.J. et al., "Transformation of Aspergillus nidulans by the orotidine-5'-phosphate decarboxylase gene of Neurospora crassa", Biochem. Biophys. Res. Commun., Apr. 15, 1983, 112(1): 284-9.
Barany, F. et al., "Genetic disease detection and DNA amplification using cloned thermostable ligase", Proc. Natl. Acad. Sci. USA, Jan. 1, 1991, 88(1): 189-93.
Barton, D.H.R. et al., "Synthesis of Novel alpha-Amino-Acids and Derivatives Using Radical Chemistry: Synthesis of L- and D-alpha-Amino-Adipic Acids, L-alpha-aminopimelic Acid and Appropriate Unsaturated Derivatives", Tetrahedron, 1987, 43(19): 4297-4308.
Bass, S. et al., "Mutant Trp repressors with new DNA-binding specificities", Science, 1988, 242: 240-245.
Batzer, M.A. et al., "Enhanced evolutionary PCR using oligonucleotides with inosine at the 3'-terminus", Nucleic Acids Res., Sep. 25, 1991, 19(18): 5081.
Beach, D. et al., "Functionally homologous cell cycle control genes in budding and fission yeast", Nature, Dec. 1982, 300: 706-709.
Beaucage, S.L. and Caruthers, M.H., "Deoxynucleoside Phosphoramidites—A New Class of Key Intermediates for Deoxypolynucleotide Synthesis", Tetrahedron Letts., 1981, 22(20): 1859-1862.
Beauchamp, C.O. et al., "A new procedure for the synthesis of polyethylene glycol-protein adducts; effects on function, receptor recognition, and clearance of superoxide dismutase, lactoferrin, and alpha 2-macroglobulin", Anal. Biochem., May 1983, 131(1): 25-33.
Belluardo, N. et al., "Comparative localization of fibroblast growth factor receptor-1, -2, and -3 mRNAs in the rat brain: in situ hybridization analysis", J. Comp. Neurol. (1997) 379(2): 226-46.
Berkowitz, K. et al., "Effect of troglitazone on insulin sensitivity and pancreatic beta-cell function in women at high risk for NIDDM", Diabetes, 1996, 45(11): 1572-9.
Bernstein, F.C. et al., "The protein data bank: a computer-based archival file for macromolecular structures", J. Mol. Biol., 1977, 112: 535-542.
Biagini, G. et al., The concept of astrocyte-kinetic drug in the treatment of neurodegenerative diseases: evidence for L-deprenyl-induced activation of reactive astrocytes, Neurochem. Int., 1994, 25(1): 17-22.
Boissel, J.P. et al., "Erythropoietin structure-function relationships. Mutant proteins that test a model of tertiary structure", Jul. 25, 1993, 268(21): 15983-93.
Boles, J.O. et al., "Bio-incorporation of telluromethionine into buried residues of dihydrofolate reductase", Nat. Struct. Biol., May 1994, 1(5): 283-4.
Botstein, D. and Shortle, D., "Strategies and applications of in vitro mutagenesis", Science, Sep. 20, 1985, 229(4719): 1193-201.
Bray, G.A., "Drug treatment of obesity", Am. J. Clin. Nutr., 1992, 55(2 Suppl): 538S-544S.
Broadhead, J., "The Spray Drying of Pharmaceuticals", Drug Dev. Ind. Pharm., 1992, 18(11&12):1169-1206.
Brunner, J. et al., "New photolabeling and crosslinking methods", Annu. Rev. Biochem., 1993, 62: 483-514.

(56) References Cited

OTHER PUBLICATIONS

Buchner, J. et al., "A method for increasing the yield of properly folded recombinant fusion proteins: Single-chain Immunotoxins from renaturation of bacterial inclusion bodies", Anal. Biochem., 1992, 205(2): 263-270.

Bückmann, A.F. and Morr, M., "Functionalization of Poly(ethylene glycol) and Monomethoxy-Poly(ethylene glycol)," Makromol. Chem., 1981, 182: 1379-84.

Budisa, N. et al., "Bioincorporation of telluromethionine into proteins: a promising new approach for X-ray structure analysis of proteins", J. Mol. Biol., Jul. 25, 1997, 270(4): 616-23.

Budisa, N. et al., "High-level biosynthetic substitution of methionine in proteins by its analogs 2-aminohexanoic acid, selenomethionine, telluromethionine and ethionine in *Escherichia coli*", Eur. J. Biochem., Jun. 1, 1995, 230(2): 788-96.

Budisa, N. et al., "Toward the experimental codon reassignment in vivo: protein building with an expanded amino acid repertoire", FASEB J., Jan. 1999, 13(1): 41-51.

Burgess, W.H. and Maciag, T., "The Heparin-Binding (Fibroblast) Growth Factor Family of Proteins", Annu. Rev. Biochem., 1989, 58: 575-606.

Cai, X-Y et al., "Expression, Purification, and Characterization of an Activated Cytokine-Suppressive Anti-Inflammatory Drug-Binding Protein 2 (CSBP2) Kinase from Baculovirus-Infected Insect Cells", Protein Expression and Purifcation, 1997, 10(2): 263-74.

Caliceti, P. and Veronese, F.M., "Pharmacokinetic and biodistribution properties of poly(ethylene glycol)-protein conjugates", Adv. Drug. Deliv. Rev., Sep. 26, 2003, 55(10): 1261-1277.

Cameron, D.P. et al., "Effects of monosodium glutamate-induced obesity in mice on carbohydrate metabolism in insulin secretion", Clin. Exp. Pharmacol. Physiol., 1978, 5(1): 41-51.

Carbonell, L.F. et al., "Baculovirus-mediated expression of bacterial genes in dipteran and mammalian cells", J. Virol., Oct. 1985, 56(1): 153-60.

Carrasco, M.R. and Brown, R.T., "A Versatile Set of Aminoxy Amino Acids for the Synthesis of Neoglycopeptides", J. Org. Chem., 2003, 68(23): 8853-8858.

Carter, P., "Improved oligonucleotide-directed mutagenesis using M13 vectors", Methods Enzymol., 1987, 154: 382-403.

Carter, P., "Improved oligonucleotide site-directed mutagenesis using M13 vectors", Nucleic Acids Res., 1985, 13(12): 4431-4443.

Carter, P., "Site-directed mutagenesis", Biochem J., Jul. 1, 1986, 237(1): 1-7.

Cech, T.R., "The chemistry of self-splicing RNA and RNA enzymes", Science, Jun. 19, 1987, 236(4808): 1532-9.

Chaiken, I.M., "Semisynthetic peptides and proteins", CRC Crit. Rev. Biochem., 1981, 11(3): 255-301.

Chin, J.W. and Schultz, P.G., "In vivo photocrosslinking with unnatural amino acid mutagenesis", Chembiochem, Nov. 4, 2002, 3(11): 1135-7.

Chin, J.W. et al., "Addition of a photocrosslinking amino acid to the genetic code of *Escherichia coli*", Proc. Natl. Acad. Sci. USA, Aug. 20, 2002, 99(17): 11020-4. Epub. Aug. 1, 2002.

Huisgen R., Chapter 1: 1,3-Dipolar Cycloadditions—Introduction, Survey, Mechanism, in 1,3-Dipolar Cycloaddition Chemistry, vol. 1, 1984; Ed. A. Padwa; John Wiley and Sons, New York, NY, 1-176.

Hwang, K.J. et al., "Hepatic uptake and degradation of unilamellar sphingomyelin/cholesterol liposomes: a kinetic study", Proc. Natl. Acad. Sci. USA, Jul. 1980, 77(7): 4030-4.

Ibba, M. and Hennecke, H., "Relaxing the substrate specificity of an aminoacyl-tRNA synthetase allows in vitro and in vivo synthesis of proteins containing unnatural amino acids", FEBS Lett., May 15, 1995, 364(3): 272-5.

Ibba, M. et al., "Substrate specificity is determined by amino acid binding pocket size in *Escherichia coli* phenylalanyl-tRNA synthetase", Biochemistry, Jun. 14, 1994, 33(23): 7107-12.

Illangakekare, M. et al., "Aminoacyl-RNA Synthesis Catalyzed by an RNA", Science, 1995, 267:643-647.

Inzucchi, S.E. et al., "Efficacy and metabolic effects of metformin and troglitazone in type II diabetes mellitus", New Engl. J. Med., 1998, 338:867-72.

Itakura, K. et al., "Expression in *Escherichia coli* of a chemically synthesized gene for the hormone somatostatin", Science, 1997, 198:1056-1063.

Ito, H. et al., "Transformation of intact yeast cells treated with alkali cations", J. Bacteriol., 1983, 153(1): 163-8.

Jackson, D.Y. et al., "A designed peptide ligase for total synthesis of ribonuclease A with unnatural catalytic residues", Science, Oct. 14, 1994, 266(1583): 243-7.

Jakobsson, P-J. et al., "Identification and characterization of a novel human microsomal glutathione S-transferase with Leukotriene C4 synthase activity and significant sequence identity to 5-lipoxygenase-activating protein and leukotriene C4 synthase", J. Biol. Chem., Sep. 6, 1996, 271(36): 22203-10.

Jencks, W.P., "Studies on the Mechanism of Oxime and Semicarbazone Formation", J. Am. Chem. Soc., 1959, 81(2): 475-481.

Joppich, M. and Luisi, P.L., "Peptides Flanked by Two Polymer Chains, 1; Synthesis of Glycyl-L-tryptophylglycine Substituted by Poly(ethylene oxide) at both the Carboxy and the Amino End Groups", Makromol. Chem., 1979, 180:1381-4.

Jung, R.I. and Chang, P., "The management of obesity", Clinical Endocrinology, 1991, 35: 11-20.

Kaiser, E.T. and Lawrence, D.S., "Chemical mutation of enzyme active sites", Science, Nov. 2, 1984, 226(4674): 505-11.

Kaiser, E.T. et al., "The chemical modification of enzymatic specificitiy", Annu. Rev. Biochem., 1985, 54: 565-95.

Kaiser, E.T., "Synthetic approaches to biologically active peptides and proteins including enzymes", Acc. Chem. Res., 1989, 22(2): 47-54.

Karlin, S. and Altschul, S.F., "Applications and statistics for multiple high-scoring segments in molecular sequences", Proc. Natl. Acad. Sci. USA, Jun. 15, 1993, 90(12): 5873-7.

Katoh, M. and Katoh, M., "FGF signaling network in the gastrointestinal tract (review)", Int'l. J. Oncology, 2006, 29: 163-168.

Kawamata, T. et al., "Intracistemal basic fibroblast growth factor enhances functional recovery and up-regulates the expression of a molecular marker of neuronal sprouting following focal cerebral infarction", Proc. Natl. Acad. Sci., 1997, 94(15): 8179-84.

Kayser, B. et al., "Alkyne bridged alpha-amino acids by palladium mediated coupling of alkynes with N-t-Boc-4-iodo-phenylalanine methyl ester", Tetrahedron, 1997, 53(7): 2475-2484.

Kelly, J.M. and Hynes, M.J., "Transformation of Aspergillus niger by the amdS gene of Aspergillus nidulans", EMBO J., 1985, 4(2): 475-479.

Kharitonekov, A. et al., "FGF-21 as a novel metabolic regulator", J. Clin. Investigation, Jun. 1, 2005, 115(6): 1627-1635.

Kharitonekov, A. et al., "The Metabolic State of Diabetic Monkeys is Regulated by Fibroblast Growth Factor-21", Endocrinology, Feb. 1, 2007, 148(2): 774-781.

Kiick, K.L. and Tirrell, D.A., "Protein Engineering by In Vivo Incorporation of Non-Natural Amino Acids: Control of Incorporation of Methionine Analogues by Methionyl-tRNA Synthetase", Tetrahedron, 2000, 56: 9487-9493.

Kiick, K.L. et al., "Incorporation of azides into recombinant proteins for chemoselective modification by the Staudinger ligation", Proc. Natl. Acad. Sci. USA, Jan. 8, 2002, 99(1): 19-24. Epub Dec. 18, 2001.

Kim, D-M and Swartz, J.R., "Prolonging cell-free protein synthesis with a novel ATP regeneration system", Biotechnol. Bioeng., 1999, 66(3): 180-8.

Kim, D-M. and Swartz, J.R., "Oxalate improves protein synthesis by enhancing ATP supply in a cell-free system derived from *Escherichia coli*", Biotechnology Letters, 2000, 22:1537-1542.

Kim, D-M. and Swartz, J.R., "Prolonging cell-free protein synthesis by selective reagent additions", Biotechnol. Prog., May-Jun. 2000, 16(3): 385-90.

Kim, D-M. and Swartz, J.R., "Regeneration of adenosine triphosphate from glycolytic intermediates for cell-free protein synthesis", Biotechnol. Bioeng., Aug. 20, 2001, 74(4): 309-16.

(56) References Cited

OTHER PUBLICATIONS

King, F.E. and Kidd, D.A.A., "A New Synthesis of Glutamine and of gamma-Dipeptides of Glutamic Acid from Phthylated Intermediates", J. Chem. Soc. 1949, 3315-3319.
Kingsman, A.J. et al., "Replication in *Saccharomyces cerevisiae* of plasmid pBR313 carrying DNA from the yeast trpl region", Gene, Oct. 1979, 7(2): 141-52.
Kitts, P.A. et al., "Linearization of baculovirus DNA enhances the recovery of recombinant virus expression vectors", Nucleic Acids Res., Oct. 11, 1990, 18(19): 5667-72.
Klein, T.M. et al., "High-velocity microprojectiles for delivering nucleic acids into living cells", Nature, 1987, 327(6117): 70-73.
Kobayashi, T. et al., "Structural basis for orthogonal tRNA specificities of tyrosyl-tRNA synthetases for genetic code expansion", Nature Stuctural Biology, 2003, 10(6): 425-432.
Kogan, T.P., "The synthesis of substituted methoxypoly(ethyleneglycol) derivatives suitable for selective protein modification", Synthetic Comm., 1992, 22(16): 2417-24.
Kool, E.T., "Synthetically modified DNAs are substrates for polymerases", Curr. Opin. Chem. Biol., Dec. 2000, 4(6): 602-8.
Koskinen, A.M.P. and Rapoport, H., "Synthesis of 4-Substituted Prolines as Conformationally Constrained Amino Acid Analogues", J. Org. Chem., 1989, 54(8): 1859-1866.
Kost, T.A. et al., "Production of a urokinase plasminogen activator-IgG fusion protein (uPA-IgG) in the baculovirus expression system", Gene, Apr. 29, 1997, 190(1): 139-44.
Kourouklis, D. et al., "Programmable ribozymes for mischarging tRNA with nonnatural amino acids and their applications to translation", Methods, 2005, 36: 239-4.
Kowal, A.K. and Oliver, J.S., "Exploiting unassigned codons in Micrococcus luteus for tRNA-based amino acid mutagenesis", Nucl. Acid. Res. (1997) 25(22): 4685-4689.
Kowal, A.K. et al., "Twenty-first aminoacyl-tRNA synthetase-suppressor tRNA pairs for possible use in site-specific incorporation of amino acid analogues into proteins in eukaryotes and in eubacteria", PNAS, USA, 2001, 98(5): 2268-2273.
Kramer, B. et al., "Different base/base mismatches are corrected with different efficiencies by the methyl-directed DNA mismatch-repair system of *E. coli*", Cell, Oct. 1984, 38(3): 879-87.
Kramer, W. and Fritz, H-J., "Oligonucleotide-directed construction of mutations via gapped duplex DNA", Methods Enzymol., 1987, 154:350-67.
Kramer, W. et al., "Improved enzymatic in vitro reactions in the gapped duplex DNA approach to oligonucleotide-directed construction of mutations", Nucleic Acids Res., Jul. 25, 1988, 16(14B): 7207.
Kramer, W. et al., "The gapped duplex DNA approach to oligonucleotide-directed mutation construction", Nucleic Acids Res., Dec. 21, 1984, 12(24): 9441-56.
Kreitman, R.J. and Pastan, I., "Purification and characterization of IL6-PE4E, a recombinant fusion of interleukin 6 with Pseudomonas exotoxin", Bioconjug Chem., Nov.-Dec. 1993, 4(6): 581-5.
Krieg, U.C. et al., "Photocrosslinking of the signal sequence of nascent preprolactin to the 54-kilodalton polypeptide of the signal recognition particle", Proc. Natl. Acad. Sci USA, Nov. 1986, 83(22): 8604-8.
Kumar, S. et al., "Troglitazone, an insulin action enhancer, improves metabolic control in NIDDM patients", Diabetologia, 1996, 39: 701-709.
Kumita, J.R. et al., "Prevention of Peptide Fibril Formation in an Aqueous Environment by Mutation of a Single Residue to Aib", Biochemistry, 2003. 42: 4492-4498.
Kunitani, M. et al., "Reversed-phase chromatography of interleukin-2 muteins", J. Chromatogr., May 30, 1986, 359: 391-402.
Mu, J. et al., "FGF21 Analogs of Sustained Action Enabled by Orthogonal Biosynthesis Demonstrate Enhanced Antidiabetic Pharmacology in Rodents", Diabetes, American Diabetes Association, 2012. 61: 505-512.
Murakami, H. et al., "Using a solid-phase ribozyme aminoacylation system to reprogram the genetic code", Chem. Biol., 2003, 10(11): 1077-84.
Nakamaye, K.L. and Eckstein, F., "Inhibition of restriction endonucleases Nci I cleavage by phosphorothioate groups and its application in oligonucleotide-directed mutagenesis", Nucleic Acids Res., Dec. 22, 1986, 14(24): 9679-98.
Nakatsuka, T. et al., "Peptide segment coupling catalyzed by the semisynthetic enzyme thiosubtilisin", J. Am. Chem. Soc., 1987, 109(12): 3808-3810.
Nambiar, K.P. et al., "Total synthesis and cloning of a gene coding for the ribonuclease S protein", Science, 1984, 223: 1299-1301.
Needham-VanDevanter, D.R. et al., "Characterization of an adduct between CC-1065 and a defined Oligodeoxynucleotide duplex", Nucleic Acids Res., 1984, 12: 6159-6168.
Needleman, S.B. and Wunsch, C.D., "A general method applicable to the search for similarities in the amino acid sequence of two proteins", J. Mol. Biol., Mar. 1970, 48(3): 443-53.
Neet, K.E. et al., "Properties of thiol-subtilisin. The consequences of converting the active serine residue to cysteine in a serine protease", J. Biol. Chem., Dec. 25, 1968, 243(24): 6392-401.
Nielsen, U.B. et al., "Therapeutic efficacy of anti-ErbB2 immunoliposomes targeted by a phage antibody selected for cellular endocytosis", Biochim. Biophys. Acta, Aug. 19, 2002, 1591(1-3): 109-118.
Nishimura, T. et al., "Identification of a Novel FGF, FGF-21, Preferentially Expressed in the Liver", Biochimica et Biophysica Acta, Jan. 1, 2000, 1492(1): 203-206.
Nishimura et al., "Structure and expression of a novel human FGF, FGF-19, expressed in the fetal brain", Biochim. Biophys. Acta, 1999, 1444: 148-151.
Nolan, J.J. et al., "Improvement in glucose tolerance and insulin resistance in obese subjects treat with troglitazone", New Engl. J. Med., 1994, 331: 1188-93.
Nomura, T. et al., "Purification, cDNA Cloning, and Expresson of UDP-Gal: Glucosylceramide Beta-1,4-Galactosyltransferase from Rat Brain", J. Biol. Chem., 1998, 273(22): 13570-7.
Noren, C.J. et al., "A general method for site-specific incorporation of unnatural amino acids into proteins", Science, Apr. 14, 1989, 244(4901): 182-8.
Nowak, M.W. et al., "Nicotinic receptor binding site probed with unnatural amino acid incorporation in intact cells", Science, Apr. 21, 1995, 268(5209): 439-42.
Offord, R.E., "Protein engineering by chemical means?", Protein Eng., 1987, 1(3): 151-157.
Ogawa, A.K. et al., "Efforts toward the Expansion of the Genetic Alphabet: Information Storage and Replication with Unnatural Hydrophobic Base Pairs", J. Am. Chem. Soc., 2000, 122(14): 3274-3287.
Ogawa, A.K. et al., "Rational Design of an Unnatural Base Pair with Increased Kinetic Selectivity", J. Am. Chem. Soc., 2000, 122(36): 8803-8804.
Ohbayashi, N. et al., "Structure and expression of the mRNA encoding a novel fibroblast growth factor, FGF-18", J. Biol. Chem., 1998, 273: 18161-18164.
Ohno, S. et al., "Co-expression of yeast amber suppressor tRNATyr and tyrosyl-tRNA synthetase in *Eschericha coli*: possibility to expand the genetic code", J. Biochem. (Tokyo, Jpn.), 1998, 124: 1065-1068.
Ohtsuka, E. et al., "An alternative approach to deoxyoligonucleotides as hybridization probes by insertion of deoxyinosine at ambiguous codon positions", J. Biol. Chem., Mar. 10, 1985, 260(5): 2605-8.
Ohuchi, H. et al., "The mesenchymal factor, FGF10, initiates and maintains the outgrowth of the chick limb bud through interaction with FGF8, an apical ectodermal factor", Development, 1997, 124: 2235-2244.
Olney, J.W., "Brain lesions, obesity, and other disturbances in mice treated with monosodium glutamate", Science, 1969, 164(3880): 719-721.

(56) References Cited

OTHER PUBLICATIONS

Olson, K. et al., "Preparation and Characterization of Poly(ethylene glycol)ylated Human Growth Hormone Antagonist", in Poly(ethylene glycol) Chemistry & Biological Applications, 1997; Eds. J.M. Harris & S. Zalipsky; ACS, Washington D.C., 170-181.
Ornitz, D.M. and Itoh, N., "Fibroblast growth factors", Genome Biol., 2001, 2(3): REVIEWS300531-3005.12.
Ozawa, K. et al., "Expression of the fibroblast growth factor family and their receptor family genes during the mouse brain development", Mol. Brain Res., 1996, 41: 279-288.
Padwa, A., "Intermolecular 1,3-Dipolar Cycloadditions", in Comprehensive Organic Synthesis, vol. 4, 1991, Ed. B.M. Trost; Pergamon, Oxford, 1069-1109.
Palva, I. et al., "Secretion of interferon by Bacillus subtilis", Gene. May-Jun. 1983, 22(2-3): 229-35.
Park, J.W. et al., "Anti-HER2 immunoliposomes: enhanced efficacy attributable to targeted delivery", Clin. Cancer Res., Apr. 2002, 8(4): 1172-81.
Park, J.W. et al., "Development of anti-P185HER2 immunoliposomes for cancer therapy", Proc. Natl. Acad. Sci. USA, Feb. 28, 1995, 92(5): 1327-31.
Pastrnak, M. et al., "A New Orthoganol Suppressor tRNA/Aminoacyl-tRNA Synthetase Pair for Evolving an Organism with an Expanded Genetic Code", Helv. Chim. Acta, 2000, 83: 2277-2286.
Patnaik, R. and Swartz, J.R., "*E. coli*-based in vitro transcription/translation: In vivo-specific synthesis rates and high yields in a batch system", Biotechniques, May 1998, 24(5): 862-8.
Pearson, J.D. et al., "The importance of silica type for reverse-phase protein separations", Anal. Biochem., 1982, 124: 217-230.
Pearson, W.R. and Lipman, D.J., "Improved tools for biological sequence comparison", Proc. Natl. Acad. Sci. USA, Apr. 1988, 85(8): 2444-8.
Peng, S. et al. "Rapid purification of recombinant baculovirus using fluorescence-activated cell sorting", BioTechniques, 1993, 14(2): 274.
Pepinsky, R.B. et al., "Improved pharmacokinetic properties of a polyethylene glycol-modified form of interferon-beta-1a with preserved in vitro bioactivity", J. Pharmacol. Exp. Ther., Jun. 2001, 297(3): 1059-66.
Pesenti, E. et al., "Suramin prevents neovascularisation and tumour growth through blocking of basic fibroblast growth factor activity", British Journal of Cancer, 1992, 66: 367-372.
Piccrilli, J.A. et al., "Enzymatic incorporation of a new base pair into DNA and RNA extends the genetic alphabet", Nature, 1990, 343:33-37.
Pintar, A. et al., "CX, an algorithm that identifies protruding atoms in proteins", Bioinformatics, Jul. 2002, 18(7): 980-984.
Pitha, J. et al., "Detergents linked to polysaccharides: preparation and effects on membranes and cells", Eur. J. Biochem., Feb. 15, 1979, 94(1): 11-18.
Plotnikov, A.N. et al., "Structural basis for FGF receptor dimerization and activation", Cell, 1999, 98(5): 641-650.
Polgar, L. and Bender, M.L., "A new enzyme containing a synthetically formed active site. Thiol-subtilisin." J. Am. Chem. Soc., 1966, 88(13): 3153-3154.
Pollack, S.J. et al., "Introduction of nucleophiles and spectroscopic probes into antibody combining sites", Science, Nov. 18, 1988, 242(4881): 1038-40.
Preneta, A.Z., "Separation on the basis of size: gel permeation chromatography", in Protein Purification Methods, a practical approach, 1989; Eds. Harris & Angal; IRL Press, Oxford, 293-306.
Raibaud, O. and Schwartz, M., "Positive control of transcription initiation in bacteria", Annu. Rev. Genet., 1984, 18: 173-206.
Reich-Slotky, R. et al., "Chimeric molecules between keratinocyte growth factor and basic fibroblast growth factor define domains that confer receptor binding specificities", J. Biol. Chem., 1995, 270: 29813-29818.
Reuss, B. et al., "Fibroblast growth factors and their receptors in the central nervous system", Cell Tissue Res., 2003, 313: 139-157.
Reverey, H. et al., "Differential Fatty Acid Selection during Biosynthetic S-Acylation of a Transmembrane Protein (HEF) and Other Proteins in Insect Cells (Sf9) and in Mammalian Cells (CV1)", J. Biol. Chem., 1996, 271(39): 23607-10.
Rivier, J. and McClintock, R., "Reversed-phase high-performance liquid chromatography of insulins from different species", J. Chromatogr., Sep. 23, 1983, 268(1): 112-9.
Roberts, S. et al., "Generation of an antibody with enhanced affinity and specificity for its antigen by protein engineering", Nature, 1987, 328: 731-734.
Chin, J.W. et al., "Addition of p-azido-L-phenylalanine to the genetic code of *Escherichia coli*", J. Am. Chem. Soc., Aug. 7, 2002, 124(31): 9026-7.
Chin, J.W. et al., "An expanded eukaryotic genetic code", Science, Aug. 15, 2003, 301(5635): 964-7.
Christie, B.D. and Rapoport, H., "Synthesis of Optically Pure Pipecolates from L-Asparagine. Application to the Total Synthesis of (+)-Apovincamine through Amino Acid Decarbonylation and Iminium Ion Cyclization", J. Org. Chem., 1985, 50(8): 1239-1246.
Clark, E.D.B., "Protein refolding for industrial processes", Curr. Opin. Biotechnol., Apr. 2001, 12(2): 202-207.
Clark, E.D.B., "Refolding of recombinant proteins", Curr. Opin. Biotechnol., Apr. 1, 1998, 9(2): 157-163.
Clark, R. et al., "Long-acting growth hormones produced by conjugation with polyethylene glycol", J. Biol. Chem., Sep. 6, 1996, 271(36): 21969-77.
Clissod, S.P. and Edwards, C., "Acarbose: A Preliminary Review of its Pharmacodynamic and Pharmacokinetic Properties, and Therapeutic Potential", Drugs, 1988, 35:214-23.
Coleman, D.L. and Eicher, E.M., "Fat(fat) and tubby(tub): two autosomal recessive mutations causing obesity syndromes in the mouse", J. Hered., 1990, 81(6): 424-7.
Coleman, D.L. et al., "Other Potentially Useful Rodents as Models for the Study of Human Diabetes Mellitus", Diabetes, 1982, 31(Suppl 1 Pt 2): 24-25.
Corey, D.R. and Schultz, P.G., "Generation of a hybrid sequence-specific single-stranded deoxyribonuclease", Science, 1987, 238(4832): 1401-1403.
Cornish, V.W. et al., "Probing Protein Sturcture and Function with an Expanded Genetic Code", Angew. Chem. Int. Ed. Engl., 1995, 34(6): 621-33.
Cornish, V.W. et al., "Site-Specific Protein Modification Using a Ketone Handle", J. Am. Chem. Soc., 1996, 118(34): 8150-8151.
Coulier, F. et al., "The FGF6 gene with the FGF multigene family", Ann. NY Acad. Sci., 1991, 638:53-61.
Craig, J.C. et al., "Absolute Configuration of the Enantiomers of 7-Chloro-4 [[4-(diethylamino)-1-methylbutyl]amino]quinoline (Chloroquinine)", J. Org. Chem., 1988, 53(6): 1167-1170.
Cregg, J.M. et al., "Pichia pastoris as a host system for transformations", Mol. Cell Biol., Dec. 1985, 5(12): 3376-85.
Crick, F.H.C. et al., "General nature of the genetic code for proteins", Nature, Dec. 30, 1961, 192: 1227-32.
Crossley, P. and Martin, G.R., "The mouse Fgf8 gene encodes a family of polypeptides and is expressed in regions that direct outgrowth and patterning in the developing embryo", Development, 1995, 121(2): 439-51.
Dale, S.J. and Belfield, M., "Oligonucleotide-directed random mutagenesis using the phophorothioate method", Methods Mol. Biol., 1996, 57: 369-374.
Das, S. et al., "Transformation of Kluyveromyces fragilis", J. Bacterial., Jun. 1984, 158(3): 1165-7.
Davis, G.D. et al.' "New fusion protein systems designed to give soluble expression in *Eschericia coli*", Biotechnol. Bioeng., Nov. 20, 1999, 65(4): 382-388.
Dawson, P.E. and Kent, S.B.H., "Synthesis of native proteins by chemical ligation", Annu. Rev. Biochem., 2000, 69: 923-60.
De Boer, H.A. et al., "The tac promoter: a functional hybrid derived from the trp and the lac promoters", Proc. Natl. Acad. Sci. USA, Jan. 1983, 80(1): 21-5.
De Louvencourt, L. et al., "Transformation of Kluyveromyces lactis by killer plasmid DNA", J. Bacterial., May 1983, 154(2): 737-42.

(56) References Cited

OTHER PUBLICATIONS

Debinski, W. et al., "A wide range of human cancers express interleukin 4 (IL4) receptors that can be targeted with chimeric toxin composed of IL4 and Pseudomonas exotoxin", J. Biol. Chem., Jul. 5, 1993, 268(19): 14065-70.
DeFronzo, R.A. et al., "Efficacy of metformin in patients with non-insulin-dependent diabetes mellitus", N. Engl. J. Med., 1995, 333(9): 541-9.
Deiters, A. et al., "Site-specific PEGylation of proteins contianing unnatural amino acids", Bioorg. Med. Chem. Lett., Dec. 6, 2004, 14(23): 5743-5.
Delgado, C. et al., "The uses and properties of PEG-linked proteins", Crit. Rev. Ther. Drug. Carrier Syst., 1992, 9(3-4): 249-304.
Deiters, A. et al., "Adding Amino Acids with Novel Reactivity to the Genetic Code of *Saccharomyces cerevisiae*", J. Am. Chem. Soc., 2003, 125(39): 11782-11783.
Dennis, M.S. et al., "Albumin binding as a general strategy for improving the pharmacokinetics of proteins", J. Biol. Chem., Sep. 20, 2002, 277(38): 35035-43, Epub Jul. 15, 2002.
Dickson, C. et al., "Expression, processing, and properties of int-2", Ann. NY Acad. Sci., 1991, 638:18-26.
Dietrich, W.D. et al., "Posttreatment with intravenous basic fibroblast growth factor reduces histopathological damage following fluid-percussion brain injury in rats", J. Neurotrauma, 1996, 13(6): 309-16.
Dolphin, C.T. et al., "Missense mutation in flavin-containing monooxygenase 3 gene, FMO3, underlies fish-odour syndrome", Nat. Genet., Dec. 1997, 17(4): 491-4.
Döring, V. et al., "Enlarging the amino acid set of *Escherichia coli* by infiltration of the valine coding pathway", Science, Apr. 20, 2001, 292(5516): 501-4.
Dougherty, D.A., "Unnatural amino acids as probes of protein structure and function", Curr. Opin. Chem. Biol., Dec. 2000, 4(6): 645-52.
Drummond, D.C. et al., "Liposomal drug delivery systems for cancer therapy", in Drug Delivery Systems in Cancer Therapy, Brown, D.M. (ed): series title Cancer Drug Discovery and Development, 2004, 191-213.
Duewel, H. et al., "Incorporation of trifluoromethionine into a phage lysozyme: implications and a new marker for use in protein 19F NMR", Biochemistry, Mar. 18, 1997, 36(11): 3404-16.
Duncan, R., "The dawning era of polymer therapeutics", Nat. Rev. Drug. Discov., May 2003, 2(5): 347-60.
Edwards, H. and Schimmel, P., "A bacterial amber suppressor in *Saccharomyces cerevisiae* is selectively recognized by a bacterial aminoacyl-tRNA synthetase", Mol. Cell Biol., 1990, 10(4): 1633-41.
Eghtedarzadeh, M.K. and Henikoff, S., "Use of oligonucleotides to generate large deletions", Nucleic Acids Res., Jun. 25, 1986, 14(12): 5115.
Elling, L. and Kula, M-R., "Immunoaffinity partitioning: synthesis and use of polyethylene glycol-oxirane for coupling to bovine serum albumin and monoclonal antibodies", Biotechnol. Appl. Biochem., Jun. 1991, 13(3): 354-62.
Elliott, S. et al., "Yeast-derived recombinant human insulin-like growth factor I: production, purification, and structural characterization", J. Protein. Chem., Feb. 1990, 9(1): 95-104.
Ellman, J. et al., "Biosynthetic method for introducing unnatural amino acids site-specifically into proteins", Methods in Enz., 1991, 202: 301-336.
Ellman, J.A. et al., "Site-specific incorporation of novel backbone structures into proteins", Science, Jan. 10, 1992, 255(5041): 197-200.
England, P.M. et al., "Backbone mutation in transmembrane domains of a ligand-gated ion channel: implications for the mechanisms of gating", Cell, Jan. 8, 1999, 96(1): 89-98.
Eppstein, D.A. et al., "Biological Activity of Liposome-Encapsulated Murine Interferon gamma is Mediated by a Cell Membrane Receptor", Proc. Natl. Acad. Sci USA, 1985, 82: 3688-3692.
Fieschko, J.C. et al., "Controlled expression and purification of human immune interferon from high-cell-density fermentations of *Saccharomyces cerevisiae*", Biotech. Bioeng., 1987, 29(9): 1113-21.
Forster, A.C. et al., "Programming peptidomimetic syntheses by translating genetic codes designed de novo", Proc. Natl. Acad. Sci. USA, May 27, 2003, 100(11): 6353-7. Epub May 16, 2003.
Frankel, A. et al., "Encodamers: unnatural peptide oligomers encoded in RNA", Chem. Biol., Nov. 2003, 10(11): 1043-50.
Fraser, M.J., "Expression of eucaryotic genes in insect cell cultures", In Vitro Cell. Dev. Biol., 1989, 25: 225-235.
Friedman, J.M. and Leibel, R.L., "Tackling a weighty problem", Cell, 1992, 69: 217-220.
Alisi, A. et al., "Commentary: FGF21 Holds Promises for Treating Obesity-related Insulin Resistance and Hepatosteatosis", Endocrinology, Nov 18, 2013, doi: 10.1210/en.2013-1828, pp. 1-4.
Chae, H-W. et al., "Spot Urine Albumin to Creatine Ratio and Serum Cystatin C are Effective for Detection of Diabetic Nephropathy in Childhood Diabetic Patients", J Korean Med Sci. 2012, 27: 784-787.
Collazo-Clavell, M.L. et al., "Assessment and Preparation of Patients for Bariatric Surgery", Mayo Clin. Proc., Oct. 2006, 81(10 suppl):S11-S17.
Folch, J. et al., "A Simple Method for the Isolation and Purification of Total Lipids from Animal Tissues", J. Biol. Chem. 1957;226: 497-509.
Fyfe, M.C.T. and Procter, M.J., "Glucokinase activators as potential antidiabetic agents possessing superior glucose lowering efficacies", Drugs of the Future, (2009) 34(8):641-653.
Gimeno, R.E. and Moller, D.E., "FGF21-bsed pharmacotherapy—potential utility for metabolic disorders", Trends Endocrinol Metab. Jun. 2014;25(6):303-11.
Hecht, R. et al., "Rationale-Based Engineering of a Potent Long-Acting FGF21 Analog for the Treatment of Type 2 Diabetes", PLoS One. 2012;7(11):e49345.
Hensrud, D.D. and Klein, S., "Extreme Obesity: A New Medical Crisis in the United States", Mayo Clin. Proc., Oct. 2006, 81(10 suppl):S5-S10.
Hensrud, D.D. and McMahon, M.M., "Bariatric Surgery in Adults with Extreme (Not Morbid) Obesity", Mayo Clin. Proc., Oct. 2006, 81(10, suppl):S3-S4.
Holland, W.L. et al., "An FGF21-Adiponectin-Ceramide Axis Controls Energy Expenditure and Insulin Action in Mice", Cell Metab. 2013; 17: 790-797.
Kendrick, M.L. and Dakin, G.F., "Surgical Approaches to Obesity", Mayo Clin. Proc., Oct. 2006, 81(10 suppl):S18-S24.
Kharitonenkov, A. and Adams, A.C., "Inventing new medicines: The FGF21 story", Mol. Metab., Avail. Online Dec. 27, 2013, 3(2014): 221-229.
Kharitonenkov, A. et al., "Rational Design of a Fibroblast Growth Factor 21-Based Clinical Candidate, LY2405319", PLOS One, Mar. 2013, 8(3) e58575: 1-10.
Kim, H.W. et al., "Fibroblast Growth Factor 21 Improves Insulin Resistance and Ameliorates Renal Injury in db/db Mice", Endocrinology, Sep. 2013, 154(9): 3366-3376.
Kleiner, D.E. et al., "Design and Validation of a Histological Scoring System for Nonalcoholic Fatty Liver Disease", Hepatology, 2005; 41:1313-1321.
Kurosu, H. et al., "Tissue-specific Expression of βKlotho and Fibroblast Growth Factor (FGF) Receptor Isoforms Determines Metabolic Activity of FGF19 and FGF21", J. Biol. Chem., 2007; 282:26687-26695.
Kushner, R.F. and Noble, C.A., "Long-term Outcome of Bariatric Surgery: An Interim Analysis", Mayo Clin. Proc., Oct. 2006, 81(10 suppl):S46-S51.
Lin, Z. et al., "Adiponectin Mediates the Metabolic Effects of FGF21 on Glucose Homeostasis and Insulin Sensitivity in Mice", Cell Metab., 2013; 17: 779-789.
McGlinch, B.P. et al., "Perioperative Care of Patients Undergoing Bariatric Surgery", Mayo Clin. Proc., Oct. 2006, 81(10 suppl):S25-S33.

(56) References Cited

OTHER PUBLICATIONS

McMahon, M.M. et al., "Clinical Management After Bariatric Surgery: Value of a Multidisciplinary Approach", Mayo Clin. Proc., Oct. 2006, 81(10 suppl):S34-45.
Ninichuk, V. et al., "Tubular Atrophy, Interstitial Fibrosis, and Inflammation in Type 2 Diabetic db/db Mice. An Accelerated Model of Advanced Diabetic Neuropathy", Eur J Med Res 2007; 12:351-355.
Planavila, A. et al., "Fibroblast growth factor 21 protects against cardiac hypertrophy in mice", Nature Comm., Jun. 17, 2013, 4:2019, doi: 10.1038/ncomms3019, pp. 1-12.
Sanyal, A.J. et al., "Endpoints and Clinical Trial Design for Non-alcoholic Steatohepatitis", Hepatology, 2011; 54:344.
Schellenberger, V. et al., "A recombinant polypeptide extends the in vivo half-life of peptides and proteins in a unable manner", Nat Biotechnol., Dec. 2009;27(12):1186-90.
Smith, T.F. and Waterman, M.S., "Identification of Common Molecular Subsequences", J Mol Biol. Mar. 25, 1981;147(1):195-7.
Subramanyam, M. (ed.), "Therapeutic Protein Immunogenicity Focus Group Newsletter," American Association of Pharmaceutical Scientists, vol. 1, Issue 3 (Dec. 2011), pp. 1-22.
Unknown, U.S. Department of Health and Human Services, "Immunogenicity Assessment for Therapeutic Protein Products," Aug. 2014, pp. 1-36.
Webster, S., "Predicting Long-Term Storage Stability of Therapeutic Proteins," Pharmaceutical Technology, vol. 37, Issue 11, pp. 42-48, Nov. 2, 2013.
Wu, Y., et al., "Enzymatic Phosphorylation of Unnatural Nucleotides", J. Am. Chem. Soc. (2002) 124:14626-14630.
Zhang, J. and Yang L., "Fibroblast growth factor 21, the endocrine FGF pathway and novel treatments for metabolic syndrome", Drug Disc. Today, May 2014, 19(5): 579-589.
Friedman, O.M. and Chatterrji, R., "Synthesis of Derivatives of Glutamine as Model Substrates for Anti-Tumor Agents", J. Am. Chem. Soc., 1959, 81(14): 3750-3752.
Friesen, P.D. and Miller, L.K., "The regulation of baculovirus gene expression", Curr. Top. Microbial. Immunol., 1986, 131: 31-49.
Fritz, H-J. et al., "Oligonucleotide-directed construction of mutations: a gapped duplex DNA procedure without enzymatic reactions in vitro", Nucleic Acids Res., Jul. 25, 1988, 16(14B): 6987-99.
Fromm, M. et al., "Expression of Genes Transferred into Monocot and Dicot Plant Cells by Electroporation", Proc. Natl. Acad. Sci. USA, 1985, 82: 5824-8.
Furter, R., "Expansion of the genetic code: site-directed p-fluorophenylalanine incorporation in *Escherichia coli*", Protein Sci., Feb. 1998, 7(2): 419-26.
Gaertner, H.F. and Offord, R.E., "Site-specific attachment of functionalized poly(ethylene glycol) to the amino terminus of proteins", Bioconjug. Chem., Jan.-Feb. 1996, 7(1): 38-44.
Gaertner, H.F. et al., "Chemo-enzymic backbone engineering of proteins. Site-specific incorporation of synthetic peptides that mimic the 64-74 disulfide loop of granulocyte colony-stimulating factor", J. Biol. Chem., Mar. 11, 1994, 269(10): 7224-30.
Gaertner, H.F. et al., "Construciton of protein analogues by site-specific condensation of unprotected fragments", Bioconjug. Chem., May-Jun. 1992, 3(3): 262-8.
Gallivan, J.P. et al., "Site-specific incorporation of biotinylated amino acids to identify surface-exposed residues in integral membrane proteins", Chem. Biol., Oct. 1997, 4(10): 739-49.
Garber, A.J. et al., "Efficacy of metformin in type II diabetes: results of a double-blind, placebo-controlled, dose-response trial", Am. J. Med., 1997, 102: 491-97.
Gellissen, G. et al., "Heterologous protein production in yeast", Antoine Van Leeuwenhoek, Aug. 1992, 62(1-2): 79-93.
Gemel, J. et al., "Structure and sequence of human FGF8", Genomics, 1996, 35:253-257.
Geoghegan, K.F. and Stroh, J.G., "Site-directed conjugation of nonpeptide groups to peptides and proteins via periodate oxidation of a 2-amino alcohol. Application to modifcation at N-terminal serine", Bioconjug. Chem., Mar.-Apr. 1992, 3(2): 138-146.

Ghosh, A.K. et al., "Molecular cloning and characterization of human FGF8 alternative messenger RNA forms", Cell Growth and Differentiation, 1996, 7(10): 1425-1434.
Gillam, S. and Smith, M., "Site-specific mutagenesis using synthetic oligodeoxyribonucleotide primers: I. Optimum conditions and minimum oligodeoxyribonucleotide length", Gene, 1979, 8(1): 81-97.
Giugliano, D. et al., "Metformin improves glucose, lipid metabolism, and reduces blood pressure in hypertensive, obese women", Diabetes Care, 1993, 16:1387-90.
Gleeson, M.A. et al., "Transformation of the methylotrophic yeast *Hansenula polymorphica*", J. Gen. Microbiol., 1986, 132: 3459-3465.
Goeddel, D.V. et al., "Synthesis of human fibroblast interferon by *E. coli*", Nucleic Acids Res., Sep. 25, 1980, 8(18): 4057-74.
Goeddel, D.V., "Systems for heterologous gene expression", Methods Enzymol., 1990, 185: 3-7.
Goldfarb, M. et al., "Expression and possible functions of the FGF-5 gene", Ann. NY. Acad. Sci., 1991, 638:38-52.
Goodson, R.J. and Katre, N.V., "Site-directed pegylation of recombinant interleukin-2 at its glycosylation site", Biotechnology (NY), Apr. 1990, 8(4): 343-346.
Graves, S.W. et al., "Expression, purification, and initial kinetic characterization of the large subunit of the human mitochondria! DNA polymerase", Biochemistry, Apr. 28, 1998, 37(17): 6050-6058.
Griffin, B.A. et al., "Specific Covalent Labeling of Recombinant Protein Molecules Inside Live Cells", Science, 1998, 281:269-272.
Grundström, T. et al., "Oligonucleotide-directed mutagenesis by microscale 'shot-gun' gene synthesis", Nucleic Acids Res., May 10, 1985, 13(9): 3305-3316.
Gu, Z. et al., "Chromatographic methods for the isolation of, and refolding of proteins from, *Escherichia coli* inclusion bodies", Protein Expr. Purif., Jun. 2002, 25(1): 174-9.
Guckian, K.M. and Kool, E.T., "High Precise Shape Mimicry by a Difluorotoluene Deoxynucleoside, and Replication-Competent Substitute for Thymidine", Angew. Chem. Int. Ed. Engl., 1997, 36(24): 2825-8.
Hamano-Takaku, F. et al., "A mutant *Escherichia coli* tyrosyl-tRNA synthetase utilizes the unnatural amino acid azatyrosine more efficiently than tyrosine" J. Biol. Chem., Dec. 22, 2000, 275(51): 40324-8.
Hang, H.C. and Bertozzi, C.R., "Chemoselective approaches to glycoprotein assembly", Acc. Chem. Res., Sep. 2001, 34(9): 727-36.
Harmer, N.J. et al., "The crystal structure of fibroblast growth factor (FGF) 19 reveals novel features of the FGF family and offers a structural basis for its unusual receptor affinity", Biochemistry, 2004, 43:629-640.
Harris, J.M. et al., "Synthesis and Characterization of Poly(ethylene Glycol) Derivatives", J. Polym. Sci. Chem. Ed., 1984, 22:341-352.
Harris, J.M., "Laboratory Synthesis of Polyethylene Glycol Derivatives", JMS—Rev. Macromol. Chem. Phys., 1985, C25(3): 325-373.
Hecht, S.M. et al., "Chemical aminoacylation of tRNA's", J. Biol. Chem., 1978, 253(13): 4517-20.
Hecht, S.M., "Probing the synthetic capabilities of a center of biochemical catalysis", Acc. Chem. Res., 1992, 25(12): 545-552.
Heckler et al., "Ribosomal binding and dipeptide formation by misacylated tRNA(Phe)'s", Biochemistry, 1988, 27(19): 7254-62.
Hendrickson, W.A. et al., "Selenomethionyl proteins produced for analysis of multiwavelength anomalous diffraction (MAD): a vehicle for direct determination of three-dimensional structure", EMBO J., May 1990, 9(5): 1665-72.
Henikoff, S. and Henikoff, J.G., "Amino Acid Substitution Matrices from Protein Blocks", Proc. Natl. Acad. Sci. USA, 1992, 89: 10915-9.
Hess, B. et al., "Cooperation of glycolytic enzymes", J. Adv. Enzyme Reg., 1969, 7: 149-67.
Hinke, S.A. et al., "Metformin effects on dipeptidylpeptidase IV degradation of glucagon-like peptide-1", Biochem. Biophys. Res. Commun., 2002, 291(5): 1302-8.

(56) References Cited

OTHER PUBLICATIONS

Hinnen, A. et al., "Transformation of yeast", Proc. Natl. Acad. Sci. USA, Apr. 1978, 75(4): 1929-33.
Hirao, I. et al., "An unnatural base pair for incoporating amino acid analogues into proteins", Nat. Biotechnol., Feb. 2002, 20(2): 177-82.
Hitzeman, R.A. et al., "Isolation and characterization of the yeast 3-phosphoglycerokinase gene (PGK) by an immunological screening technique", J. Biol. Chem., Dec. 25, 1980, 255(24): 12073-80.
Hoffmann, K and Bohn, H., "Studies on polypeptides. XXXVI. The effect of pyrazole-imidazole replacements on the S-protein activating potency of an S-peptide fragment", J. Am. Chem. Soc., 1966, 88(24): 5914-5919.
Hohsaka, T. and Sisido, M., "Incorporation of non-natural amino acids into proteins", Curr. Opin. Chem. Biol., Dec. 2002, 6(6): 809-15.
Hohsaka, T. et al., "Efficient Incorporation of Nonnatural Amino Acids with Large Aromatic Groups into Streptavidin in In Vitro Protein Synthesizing Systems", J. Am. Chem. Soc., 1999, 121(1): 34-40.
Hohsaka, T. et al., "Incorporation of Two Different Nonnatural Amino Acids Independently into a Single Protein through Extension of the Genetic Code", J. Am. Chem. Soc., 1999, 121(51): 12194-12195.
Holland, M.J. and Holland, J.P., "Isolation and identification of yeast messenger ribonucleic acids coding for enolase, glyceralehyde-3-phosphate dehydrogenase, and phosphoglycerate kinase", Biochemistry, Nov. 14, 1978, 17(23): 4900-7.
Holland, M.J. et al., "The primary structures of two yeast enolase genes. Homology between the 5' noncoding flanking regions of yeast enolase and glyceraldehyde-3-phosphate dehydrogenase genes", J. Biol. Chem., Feb. 10, 1981, 256(3): 1385-95.
Hoshikawa, M. et al., "Structure and expression of a novel fibroblast growth factor, FGF-17, preferentially expressed in the embryonic brain", Biochem. Biophys. Res. Commun., 1998, 244(1): 187-91.
Hsiao, C-L. and Carbon, J., "High-frequency transformation of yeast by plasmids containing the cloned yeast ARG4 gene", Proc. Natl. Acad. Sci. USA, Aug. 1979, 76(8): 3829-33.
Hübinger, A. et al., "The effect of etomoxir on insulin sensitivity in type 2 diabetic patients", Hormone Metab. Res., 1992, 24:115-18.
Kunkel, T.A., "The efficiency of oligonucleotide directed mutagenesis", in Nucleic Acids & Molecular Biology vol. 2, 1987, Eckstein, F. and Lilley, D.M.J. eds., Springer Verlag, Berlin, 124-135.
Kunkel, T.A. et al., "Rapid and efficient site-specific mutagenesis without phenotypic selection", Methods Enzymol. 1987, 154: 367-82.
Kunkel, T.A., "Rapid and efficient site-specific mutagenesis without phenotypic selection", Proc. Natl. Acad. Sci. USA, Jan. 1985, 82(2): 488-92.
Kunze, G. et al., "Transformation of the industrially important yeasts Candida maltosa and Pichia guillermondii", J. Basic Microbiol. 1985, 25: 141-4.
Kurosu, H. et al., "Regulation of fibroblast growth factor-23 signalling by Klotho", J. Biol. Chem., 2006, 281(10): 6120-3.
Kurtz, M.B. et al., "Integrative transformation of Candida albicans, using a cloned Candida ADE2 gene", Mol. Cell Biol., Jan. 1986, 6(1): 142-9.
Kurtzhals, P. et al., "Albumin binding of insulins acylated with fatty acids: characterization of the ligand-protein interaction and correlation between binding affinity and timing of the insulin effect in vivo", Biochem J., Dec. 15, 1995, 312(Pt. 3): 725-31.
Langer, R. et al., "Biocompatibility of polymeric delivery systems for macromolecules", J. Biomed. Mater. Res., Mar. 1981, 15(2): 267-77.
Langer, R., "Controlled release of macromolecules", Chem. Tech., 1982, 12:98-105.
Liebman, J.M. et al., "When less is more: enhanced baculovirus production of recombinant proteins at very low multiplicities of infection", Biotechniques, Jan. 1999, 26(1): 36-42.

Lilie, H. et al., "Advances in refolding of proteins produced in E. coli", Curr. Opin. Biotechnol. Oct. 1998, 9(5): 497-501.
Ling, M.M. and Robinson, B.H., "Approaches to DNA mutagenesis: an overview", Anal. Biochem., Dec. 15, 1997, 254(2): 157-178.
Liu, D.R. and Schultz, P.G., "Progress toward the evolution of an organism with an expanded genetic code", Proc. Natl. Acad. Sci. USA, Apr. 27, 1999, 96(9): 4780-5.
Liu, H. et al., "A Method for the Generation of Glycoprotein Mimetics", J. Am. Chem. Soc. USA, 2003, 125(7): 1702-1703.
Lohse, P.A. and Szostak, J.W., "Ribozyme-catalysed amino-acid transfer reactions", Nature, 1996, 381: 442-444.
Lorimer, I.A.J. and Pastan, I., "Random recombination of antibody single chain Fv sequences after fragmentation with DnaseI in the presence of Mn2+", Nucleic Acids Res., Aug. 11, 1995, 23(15): 3067-8.
Lu, W. et al., "Site-specific incorporation of a phosphotyrosine mimetic reveals a role for tyrosine phosphorylation of SHP-2 in cell signaling", Mol. Cell., 2001, 8(4): 759-769.
Lu, T. et al., "Probing ion permeation and gating in a K+ channel with backbone mutations in the selectivity filter", Nature Neurosci., Mar. 2001, 4(3): 239-246.
Luckow, V.A. and Summers, M.D., "High level expression of nonfused foreign genes with Autographa californica nuclear polyhedrosis virus expression vectors", Virology, May 1989, 170(1): 31-39.
Lyons, M.K. et al., "Basic fibroblast growth factor promotes in vivo cerebral angiogenesis in chronic forebrain ischema", Brain Res., 1991, 558: 315-320.
Ma, C. et al., "In vitro protein engineering using synthetic tRNA(Ala) with different anticodons", Biochemistry, Aug. 10, 1993, 32(31): 7939-45.
Maggs, D.G. et al., "Metabolic effects of troglitazone monotherapy in type 2 diabetes mellitus. A randomized, double-blind, placebo-controlled trial", Ann. Intern. Med., 1998, 128: 176-85.
Magliery, T.J. et al., "Expanding the Genetic Code: Selection of Efficient Suppressors of Four-base Codons and Identification of "Shifty" Four-base Codons with a Library Approach in Escherichia coli", J. Mol. Biol., Mar. 30, 2001, 307(3): 755-769.
Mahal, L.K. et al., "Engineering chemical reactivity on cell surfaces through oligosaccharide biosynthesis", Science, May 16, 1997, 276(5315): 1125-8.
Makrides, S.C. et al., "Extended in vivo half-life of human soluble complement receptor type 1 fused to a serum albumin-binding receptor", J. Pharmacol. Exp. Ther., Apr. 1996, 277(1): 534-42.
Mamot, C. et al., "Epidermal growth factor receptor (EGFR)-targeted immunoliposomes mediate specific and efficient drug delivery to EGFR- and EGFRvIII-overexpressing tumor cells", Cancer Res., Jun. 15, 2003, 63(12): 3154-61.
Mandecki, W. "Oligonucleotide-directed double-strand break repair in plasmids of Escherichia coli: a method for site-specific mutagenesis", Proc. Natl. Acad. Sci. USA, Oct. 1986, 83(19): 7177-81.
Mann, S.G. and King, L.A., "Efficient transfection of insect cells with baculovirus DNA using electroporation", J. Gen. Virol., Dec. 1989, 70(Pt. 12): 3501-5.
Mannucci, E. et al., "Effect of metformin on glucagon-like peptide 1 (GLP-1) and leptin levels in obese nondiabetic subjects", Diabetes Care, 2001, 24(3): 489-94.
Matsoukas, J.M. et al., "Differences in backbone structure between angiotensin II agonists and type I antagonists", J. Med. Chem., Nov. 10, 1995, 38(23): 4660-9.
Mattson, M.P. et al., "Neurotrophic factor mediated protection from excitotoxicity and disturbances in calcium and free radical metabolism", Semin. Neurosci., 1993, 5: 295-307.
McCorkle, G.M. and Altman, S., "RNA's as Catalysts", Concepts Biochem., 1987, 64(3): 221-226.
McKeehan, W.L. et al., "The heparin sulfate-fibroblast growth factor family: diversity of structure and function", Prog. Nucleic Acids Res. Mol. Biol., 1998, 59: 135-176.

(56) References Cited

OTHER PUBLICATIONS

McMinn, D.L. et al., "Efforts toward Expansion of the Genetic Alphabet: DNA Polymerase Recognition of a Highly Stable, Self-Pairing Hydrophobic Base", J. Am. Chem. Soc., 1999, 121(49): 11585-6.

McWhirter, J.R. et al., "A novel fibroblast growth factor gene expressed in the developing nervous system is a downstream target of the chimeric homeodomain oncoprotein E2A-Pbx1", Development, 1997, 124: 3221-3232.

Meggers, E. et al., "A Novel Copper-Mediated DNA Base Pair", J. Am. Chem. Soc., 2000, 122(43): 10714-10715.

Mehl, R.A. et al., "Generation of a bacterium with a 21 amino acid genetic code", J. Am. Chem. Soc., Jan. 29, 2003, 125(4): 935-9.

Mehvar, R., "Modulation of the pharmacokinetics and pharmacodynamics of proteins by polyethylene glycol conjugation", J. Pharm. Sci., Jan.-Apr. 2000, 3(1): 125-36.

Mendel, D. et al., "Site-directed mutagenesis with an expanded genetic code", Annu. Rev. Biophys. Biomol. Struct., 1995, 24:435-62.

Miller, J.C. et al., "Flash decaging of tyrosine sidechains in an ion channel", Neuron, Apr. 1998, 20(4): 619-24.

Miller, L.K., "Baculovirus as gene expression vectors", Ann. Rev. Microbiol., 1988, 42: 177-99.

Miller, L.K., "Insect baculoviruses: powerful gene expression vectors", Bioessays, Oct. 1989, 11(4): 91-5.

Miller, J.L. and Chaconas, G., "Electron microscopic analysis of in vitro transposition intermediates of bacteriophage Mu DNA", Gene, 1986, 48(1): 101-8.

Mimura, K. et al., "Effects of a new hypoglycaemic agent (CS-045) on metabolic abnormalities and insulin resistance in type 2 diabetes", Diabetic Med., 1994, 11: 685-91.

Minks, C. et al., "Noninvasive tracing of recombinant proteins with 'fluorophenylalanine-fingers'", Anal. Biochem., Aug. 15, 2000, 284(1): 29-34.

Miyake, A. et al., "Structure and expression of a novel member, FGF-16, on the fibroblast growth factor family", Biochem. Biophys. Res. Commun., 1998, 243: 148-152.

Miyanohara, A. et al., "Expression of hepatitis B surface antigen gene in yeast", Proc. Natl. Acad. Sci. USA, Jan. 1983, 80(1): 1-5.

Moore, B. et al., "Quadruplet codons: implications for code expansion and the specification of translation step size", J. Mol. Biol., 2000, 298(2): 195-209.

Mosbach, K. et al., "Formation of proinsulin by immobilized Bacillus subtilis", Nature, Apr. 1983, 302: 543-545.

Moyers et al., "Molecular determinants of FGF-21 activity-synergy and cross-talk with PPARgamma signaling", J. Cellular Physiology, Jan. 1, 2007, 210(1): 1-6.

Roberts, R.W. and Szostak, J.W., "RNA-peptide fusions for the in vitro selection of peptides and proteins", Proc. Natl. Acad. Sci USA, Nov. 11, 1997, 94(23): 12297-302.

Robertson, S.A. et al., "A General and Efficient Route for Chemical Aminoacylation of Transfer RNAs", J. Am. Chem. Soc., 1991, 113: 2722-2729.

Roggenkamp, R. et al., "Transformation of the methylotrophic yeast *Hansenula polymorpha* by autonomous replication and integration vectors", Mol. Gen. Genet., 1986, 202(2): 302-8.

Romani, S. et al., "Synthesis of unsymmetrical cystine peptides: directed disulfide pairing with the sulfenohydrazide method", in Chemistry of Peptides and Proteins, 1984; eds. Voelter, W. et al.; Walter de Gruyter et al., Berlin; vol. 2: 29-33.

Romanos, M.A. et al., "Foreign gene expression in yeast: a review", Yeast, Jun. 1992, 8(6): 423-88.

Rosenthal, G.A., "L-canaline: a potent antimetabolite and anti-cancer agent from leguminous plants", Life Sci., 1997, 60(19): 1635-41.

Rossolini, G.M. et al., "Use of deoxyinosine-containing primers vs degenerate primers for polymerase chain reaction based on ambiguous sequence information", Mol. Cell. Probes, 1994, 8: 91-98.

Rostovtsev, V.V. et al., "A stepwise huisgen cycloaddition process: copper(I)-catalyzed regioselective "ligation" of azides and terminal alkynes", Angew. Chem. Int. Ed. Engl., Jul. 15, 2002, 41(14): 2596-9.

Rowles, J. et al., "Cloning and characterization of PDK4 on 7q21.3 encoding a fourth pyruvate dehydrogenase kinase isoenzyme in human", J. Biol. Chem., Sep. 13, 1996, 271(37): 22376-82.

Sakamoto, K et al., "Site-specific incorporation of an unnatural amino acid into proteins in mammalian cells", Nucleic Acids Res., 2002, 30(21): 4692-4699.

Sakmar, T.P. and Khorana, H.G., "Total synthesis and expression of a gene for the alpha-subunit of bovine rod outer segment guanine nucleotide-binding protein (transducin)", Nucleic Acids Res., Jul. 25, 1988, 16(14A): 6361-72.

Saks, M.E. et al., "An engineered Tetrahymena tRNAGln for in vivo incorporation of unnatural amino acids into proteins by nonsense suppression", J. Biol. Chem., 1996, 271(38): 23169-75.

Sandler and Karo, "Polyoxylalkylation of hydroxyl compounds", in Polymer Synthesis, vol. 3, 1980; Academic Press, New York, 138-161.

Santoro, S.W. et al., "An efficient system for the evolution of aminoacyl-tRNA synthetase specificity", Nat. Biotechnol., Oct. 2002, 20(10): 1044-8. Epubl Sep. 16, 2002.

Sartore, L. et al., "Enzyme modification by MPEG with an amino acid or peptide as spacer arms", Appl. Biochem. Biotechnol., Jan. 1991, 27(1): 45-54.

Sawhney, A.S. et al., "Bioerodible Hydrogels Based on Photopolymerized Poly(ethylene glycol)-co-poly(alpha-hydroxy acid) Diacrylate Macromers", Macromolecules, 1993, 26(4): 581-7.

Saxon, E. and Bertozzi, C., "Cell Surface Engineering by a Modified Staudinger Reaction", Science, 2000, 287(5460): 2007-2010.

Sayers, J.R. et al., "5'-3' exonucleases in phosphorothioate-based oligonucleotide-directed mutagenesis", Nucleic Acids Res., Feb. 11, 1988, 16(3): 791-802.

Sayers, J.R. et al., "Strand specific cleavage of phosphorothioate-containing DNA by reaction with restriction endonucleasese in the presense of ethidium bromide", Nucleic Acids Res., Feb. 11, 1988, 16(3): 803-14.

Schanbacher, F.L. and Ebner, K.E., "Galactosyltransferase Acceptor Specificity of the Lactose Synthetase A Protein", J. Biol. Chem., 1970, 245(19): 5057-5061.

Scheen, A.J. and Lefebvre, P.J., "Troglitazone: antihyperglycemic activity and potential role in the treatment of type 2 diabetes", Diabetes Care, 1999, 22(9): 1568-1577.

Schmidt, M. et al., "Baculovirus-mediated large-scale expression and purification of a polyhistidine-tagged rubella virus capsid protein", Protien Expr. Purif., Apr. 1998, 12(3): 323-30.

Schneider, E. et al., "Functional Purification of a Bacterial ATP-Binding Cassette Transporter Protein (MalK) from the Cytoplasmic Fraction of an Overproducing Strain", Protein Expr. Purif., 1995, 6(1): 10-14.

Schnölzer, M. and Kent, S.B.H. "Constructing proteins by dovetailing unprotected synthetic peptides: backbone-engineered HIV protease", Science, Apr. 10, 1992, 256(5054): 221-5.

Schumacher, B. et al., "Induction of neoangiogenesis in ischemic myocardium by human growth factors: first clinical results of a new treatment of coronary heart disease", Circulation, 1998, 97: 645-650.

Schwartz, S. et al., "Effect of troglitazone in insulin-treated patients with type II diabetes mellitus. Troglitazone and Exogenous Insulin Study Group", New Engl. J. Med., 1998, 338: 861-66.

Scouten, W.H., "A survey of enzyme coupling techniques", Methods Enzymol., 1987, 135: 30-65.

Shafrir, E. et al., "Regulation of muscle malonyl-CoA levels in the nutritionally insulin-resistant desert gerbil, *Psammomys obesus*", Diabetes Metab Res Rev, 2002, 18(3): 217-23.

Shamsir, M.S. and Dalby, A.R., "β-Sheet Containment by Flanking Prolines: Molecular Dynamic Simulations of the Inhibition of the β-Sheet Elongation by Proline Residues in Human Prion Protein", Biophysical Journal, Mar. 2007. 92: 2080-2089.

(56) References Cited

OTHER PUBLICATIONS

Shao, J. and Tam, J.P., "Unprotected Peptides as Building Blocks for the Synthesis of Peptide Dendrimers with Oxime, Hydrazone, and Thiazolidine Linkages", J. Am. Chem. Soc., 1995, 117(14): 3893-3899.
Sharma, N. et al., "Efficient introduction of an aryl bromide functionality into proteins in vivo", FEBS Lett., Feb. 4, 2000, 467(1): 37-40.
Shimatake, H. and Rosenberg, M., "Purified gamma regulatory protein cII positively activates promoters for lysogenic development", Nature, Jul. 1981, 292: 128-132.
Shine, J. and Dalgarno, L., "Determinant of cistron specificity in bacterial ribosomes", Nature, Mar. 6, 1975, 254(5495): 34-8.
Sidman, K.R. et al., "Controlled release of macromolecules and pharmaceuticals from synthetic polypeptides based on glutamic acid", Biopolymers, Jan. 1983, 22(1): 547-56.
Sieber, V. et al., "Libraries of hybrid proteins from distantly related sequences", Nature Biotechnology, May 2001, 19: 456-460.
Siffert, W. et al., "Association of a human G-protein beta3 subunit variant with hypertension", Nat. Genet., Jan. 1998, 18(1): 45-8.
Sikorski, R.S. and Hieter, P., "A System of Shuttle Vectors and Yeast Host Strains Designed for Efficient Manipulation of DNA in *Saccharomyces cerevisiae*", Genetics, 1989, 122: 19-27.
Sisk, W.P. et al., "High-level expression and purification of secreted forms of herpes simplex virus type 1 glycoprotein gD synthesized by baculovirus-infected insect cells", J. Virol., Feb. 1994, 68(2): 766-75.
Sjölander, A. et al., "The serum albumin-binding region of steprococcal protein G: a bacterial fusion partner with carrier-related properties", J. Immunol. Methods, Feb. 14, 1997, 201(1): 115-23.

Smallwood et al., "Fibroblast growth factor (FGF) homologous factors: new members of the FGF family implicated in nervous system development", PNAS USA, 1996, 93: 9850-9857.
Smith, G.E., et al., "Production of human beta interferon in insect cancer cells infected with a baculovirus expression vector", Mol. Cell. Biol., 1983, 3(12): 2156-2165.
Smith, M., "In vitro mutagenesis", Ann. Rev. Genet., 1985, 19: 423-462.
Spencer, S.A. et al., "Rabbit liver growth hormone receptor and serum binding protein. Purification, characterization, and sequence", J. Biol. Chem., 1988, 263: 7862-7867.
Stanley, S.L. et al., "The serine-rich Entamoeba histolytica protein is a phosphorylated membrane protein containing O-linked terminal N-acetylglucosamine residues", J. Biol. Chem., Feb. 24, 1995, 270(8): 4121-6.
Steitz, J.A., "Genetic signals and nucleotide sequences in messenger RNA", in Biological Regulation and Development: Gene Expression, 1979; ed. R.F. Goldberger, Plenum Press, New York: 349-399.
Stemmer, W.P.C., "DNA shuffling by random fragmentation and reassembly: In vitro recombination for molecular evolution", Proc. Natl. Acad. Sci USA, Oct. 25, 1994, 91(22): 10747-51.
Stemmer, W.P.C., "Rapid evolution of a protein in vitro by DNA shuffling", Nature, 1994, 370(4): 389-391.
Studier, F.W. and Moffatt, B.A., "Use of bacteriophage T7 RNA polymerase to direct selective high-level expression of cloned genes", J. Mol. Biol., May 5, 1986, 189(1): 113-30.
Subasinghe, N. et al., "Quisqalic acid analogues: synthesis of beta-heterocyclic 2-aminopropanoic acid derivatives and their activity at a novel quisqualate-sensitized site", J. Med. Chem., Nov. 27, 1992, 35(24): 4602-7.
Fukumoto, S., "Actions and Mode of Actions of FGF19 Subfamily Members", Endocrine Journal, 2008; 55(1): 23-31.
Suzuki, M. et al., "βKlotho Is Required for Fibroblast Growth Factor (FGF) 21 Signaling through FGF Receptor (FGFR) 1c and FGFR3c", Molecular Endocrinology, 2008; 22(4): 1006-1014.

FIG. 1A

| Compound Name | SEQ ID NO: | Amino Acid 108 | PEG Mol. Wt. | Amino Acids 109-149 | Amino Acids 169-181 |
|---|---|---|---|---|---|
| Compound 1 | 101 | Q | n/a | SEAHGLPLHLPGNKSPHRDPAPRGPAPRFLPLPGLPPAPPEP | VGPSQGRSPSYAS |
| Compound 2 | 102 | Q | n/a | SEAHGLPLHL-GSG--------RGPAPRFLPLPGLPPAPPEP | VEPSQGRSPSYAS |
| Compound 3 | 103 | Q | n/a | SEAHGLPLHLPGNKSPHRDPAPRGPAPRFLPLPGLPPAPPEP | VEPSQGRSPSYAS |
| Compound 4 | 104 | Q | n/a | SEAHGLPLHLPGKKSPHRDPAPRGPAPRFLPLPGLPPAPPEP | VEPSQGRSPSYAS |
| Compound 5 | 105 | Q | n/a | SEAHGLPLHLPGDKS----RDPAPRGPAPRFLPLPGLPPAPPEP | VEPSQGRSPSYAS |
| Compound 6 | 106 | Q | n/a | SEAHGLPLHLPGHKS----RDPAPRGPAPRFLPLPGLPPAPPEP | VEPSQGRSPSYAS |
| Compound 7 | 107 | Q | n/a | SEAHGLPLHLPGQKSPHRDPAPRGPAPRFLPLPGLPPAPPEP | VEPSQGRSPSYAS |
| Compound 8 | 108 | Q | n/a | SEAHGLPLHL-GSG--------ARFLPLPGLPPAPPEP | VEPSQGRSPSYAS |
| Compound 9 | 109 | Q | n/a | SEAHGLPLHLPGQKSPHRDPAPRGPAPRFLPLPGLPPAPPEP | VEPSQGRSPSYAS |
| Compound 10 | 110 | Q | n/a | SEAHGLPLHL-GSG--------GPARFLPLPGLPPAPPEP | VEPSQGRSPSYAS |
| Compound 11 | 111 | Q | n/a | SEAHGLPLHL-GSGH-------RDPAPRGPAPRFLPLPGLPPAPPEP | VEPSQGRSPSYAS |
| Compound 12 | 112 | Q | n/a | SEAHGLPLHL-GSG--------RDPAPRGPAPRFLPLPGLPPAPPEP | VEPSQGRSPSYAS |
| Compound 13 | 113 | Q | n/a | SEAHGLPLHLPHHSG----QDPAPRGPAPRFLPLPGLPPAPPEP | VGPSQGRSPSYAS |
| Compound 14 | 114 | Q | n/a | SEAHGLPLHLPGHKS----RDPAPRGPAPRFLPLPGLPPAPPEP | VEPSQGRSPSYAS |
| Compound 15 | 115 | Q | n/a | SEAHGLPLHLPGHKS----RDPAPRGPAPRFLPLPGLPPAPPEP | VEPSQGRSPSYAS |
| Compound 16 | 116 | Q | n/a | SEAHGLPLHLPGHKS----RDPAPRGPAPRFLPLPGLPFAPPEP | V-PSQGRSPSYAS |
| Compound 17 | 117 | Q | n/a | SEAHGLPLHLPGHKS----RDPAPRGPAPRFLPLFGLPFAPPEP | VG-SQGRSPSYAS |
| Compound 18 | 118 | Q | n/a | SEAHGLPLHLPGNKSPHRDPAPRGPAPRFLPLFGLPFAPPEP | VEP---------- |
| Compound 19 | 119 | Q | n/a | SEAHGLPLHL-GSGP-HRDPAPRGPAPRFLPLFGLPFAPPEP | VEPSQGRSPSYAS |
| Compound 20 | 120 | Q | n/a | SEAHGLPLHL-GGH-------RDPAPRGPAPRFLPLFGLPFAPPEP | VEPSQGRSPSYAS |
| Compound 21 | 121 | Q | n/a | SEAHGLPLHL-GSG-------RDPAPRGPAPRFLPLFGLPFAPPEP | VEPSQGRSPSYAS |
| Compound 22 | 122 | Q | n/a | SEAHGLPLHLSGG--------PAPRGPAPRFLPLFGLPFAPPEP | VEPSQGRSPSYAS |
| Compound 23 | 123 | Q | n/a | SEAHGLPLHLPGG--------GPARFLPLFGLPFAPPEP | VEPSQGRSPSYAS |

FIG. 1B

| Compound Name | SEQ ID NO: | Amino Acid 108 | PEG Mol. Wt. | Amino Acids 109-149 | | Amino Acids 169-181 |
|---|---|---|---|---|---|---|
| Compound 24 | 124 | Q | n/a | SEAHGLPLHLPG--------------- | G--RFLPLPGLPPAPPEP | VEPSQGRSPSYAS |
| Compound 25 | 125 | Q | n/a | SEAHGLPLHLP--SG------------- | G--RFLPLPGLPPAPPEP | VEPSQGRSPSYAS |
| Compound 26 | 126 | Q | n/a | SEAHGLPLH--SGG-------------- | PAPRGPARFLPLPGLPPAPPEP | VEPSQGRSPSYAS |
| Compound 27 | 127 | Q | n/a | SEAHGLPLH---GSG------------- | GPARFLPLPGLPPAPPEP | VEPSQGRSPSYAS |
| Compound 28 | 128 | Q | n/a | SEAHGLP-H---GG-------------- | RFLPLPGLPPAPPEP | VEPSQGRSPSYAS |
| Compound 29 | 129 | Q | n/a | SEAHGLP-H--SGG-------------- | RFLPLPGLPPAPPEP | VEPSQGRSPSYAS |
| Compound 30 | 130 | Q | n/a | SEAHGLP-R---GSG------------- | RFLPLPGLPPAPPEP | VEPSQGRSPSYAS |
| Compound 31 | 131 | Q | n/a | SEAHGLPLHL--GSG------------- | GPARFLPLPGLPPAPPEP | VTPSQGRSPSYAS |
| Compound 32 | 132 | Q | n/a | SEAHGLPLHL--GSG------------- | GPARFLPLPGLPPALPEP | VGPSQGRSPSYAS |
| Pegylated Compound 1 | 201 | pAF | 30 kDa | SEAHGLPLHLPGNKSPHRDPAPRGPARFLPLPGLPPAPPEP | | VGPSQGRSPSPSYAS |
| Pegylated Compound 2 | 202 | pAF | 30 kDa | SEAHGLPLHLPGNKS--------------- | RGPARFLPLPGLPPAPPEP | VEPSQGRSPSPSYAS |
| Pegylated Compound 5 | 205 | pAF | 30 kDa | SEAHGLPLHLPGDKS--------------- | RDPAPRGPARFLPLPGLPPAPPEP | VEPSQGRSPSPSYAS |
| Pegylated Compound 6 | 206 | pAF | 30 kDa | SEAHGLPLHLPGHKS--------------- | RDPAPRGPARFLPLPGLPPAPPEP | VEPSQGRSPSPSYAS |
| Pegylated Compound 10 | 210 | pAF | 30 kDa | SEAHGLPLHL--GSGH------------- | RDPAPRGPARFLPLPGLPPAPPEP | VEPSQGRSPSPSYAS |
| Pegylated Compound 11 | 211 | pAF | 30 kDa | SEAHGLPLHL--GSGH------------- | GPARFLPLPGLPPAPPEP | VEPSQGRSPSPSYAS |
| Pegylated Compound 12 | 212 | pAF | 30 kDa | SEAHGLPLHLPHHSG--------------- | RDPAPRGPARFLPLPGLPPAPPEP | VEPSQGRSPSPSYAS |
| Pegylated Compound 19 | 219 | pAF | 30 kDa | SEAHGLPLHL--GSGP------------- | HRDPAPRGPARFLPLPGLPPAPPEP | VEPSQGRSPSPSYAS |
| Pegylated Compound 20 | 220 | pAF | 30 kDa | SEAHGLPLHL--GGH-------------- | RDPAPRGPARFLPLPGLPPAPPEP | VEPSQGRSPSPSYAS |
| Pegylated Compound 21 | 221 | pAF | 30 kDa | SEAHGLPLHL--GSG------------- | RDPAPRGPARFLPLPGLPPAPPEP | VEPSQGRSPSPSYAS |
| Pegylated Compound 22 | 222 | pAF | 30 kDa | SEAHGLPLHLSGG--------------- | PAPRGPARFLPLPGLPPAPPEP | VEPSQGRSPSPSYAS |
| Pegylated Compound 23 | 223 | pAF | 30 kDa | SEAHGLPLHL--GG-------------- | GPARGPARFLPLPGLPPAPPEP | VEPSQGRSPSPSYAS |

FIG. 4. Thermal Stability by Thermal Scanning Fluorescence (TSF)

*Enhanced in vivo (murine Ob/Ob) Potency Reflects Increased Exposure to Active Protein*

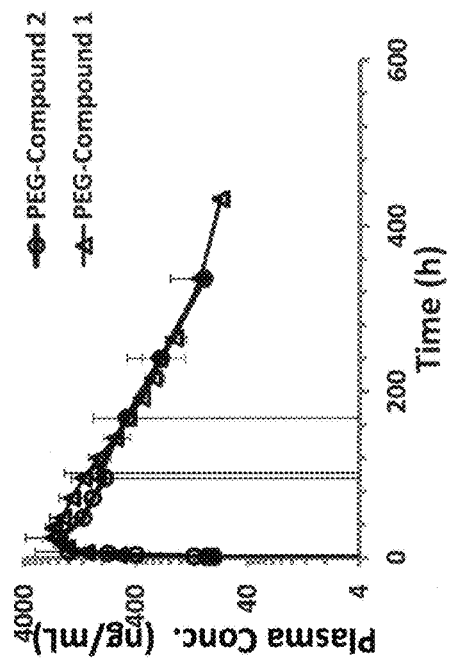
FIG. 11A "Total" Protein PK
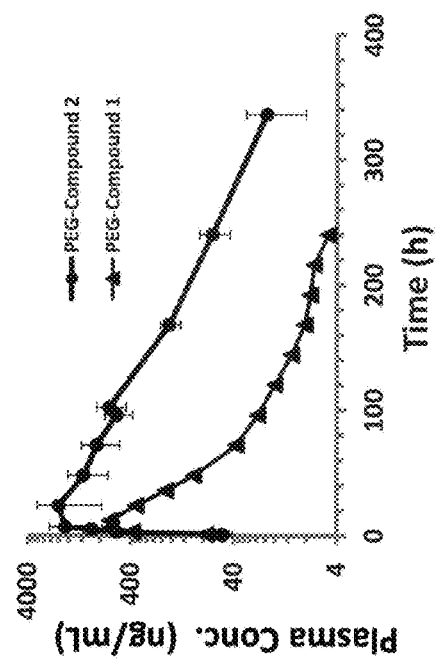
FIG. 11B C-term Intact PK

FIG. 19. Body weight changes
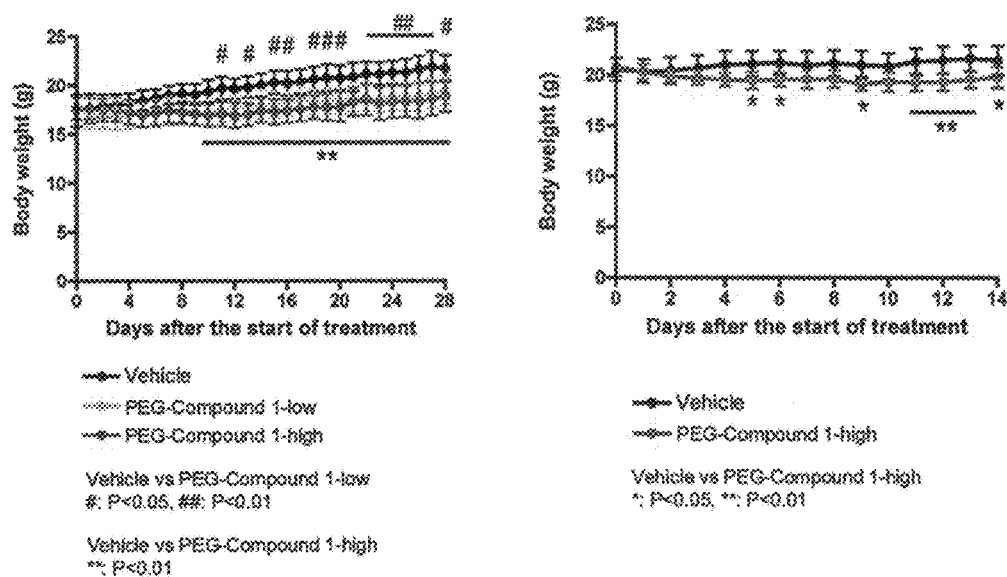
FIG. 20. Total food consumption
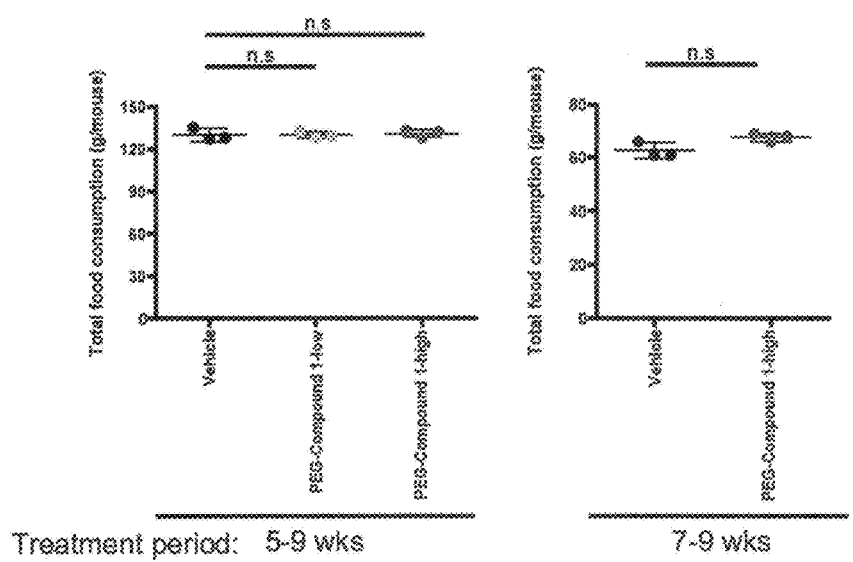

FIG. 21. Body weight
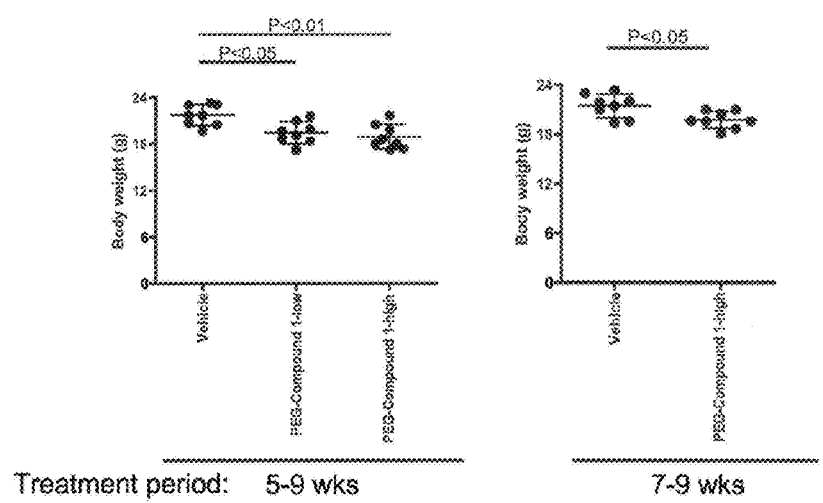
FIG. 22. Liver weight
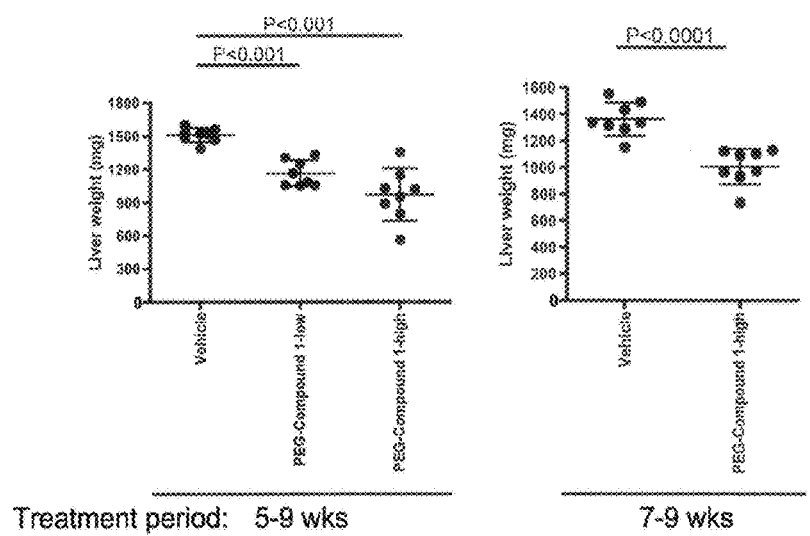

FIG. 23. Liver-to-body weight ratio
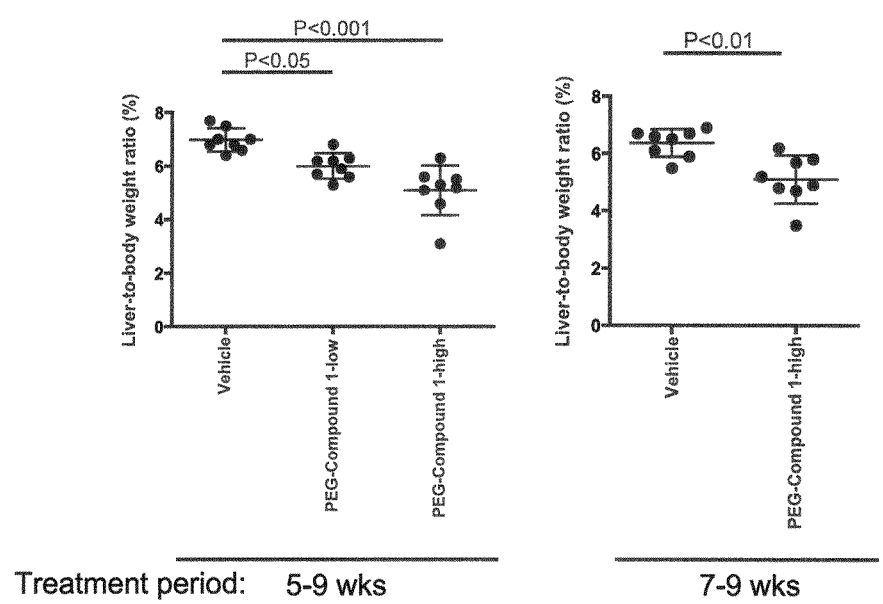

FIG. 24. Whole blood glucose
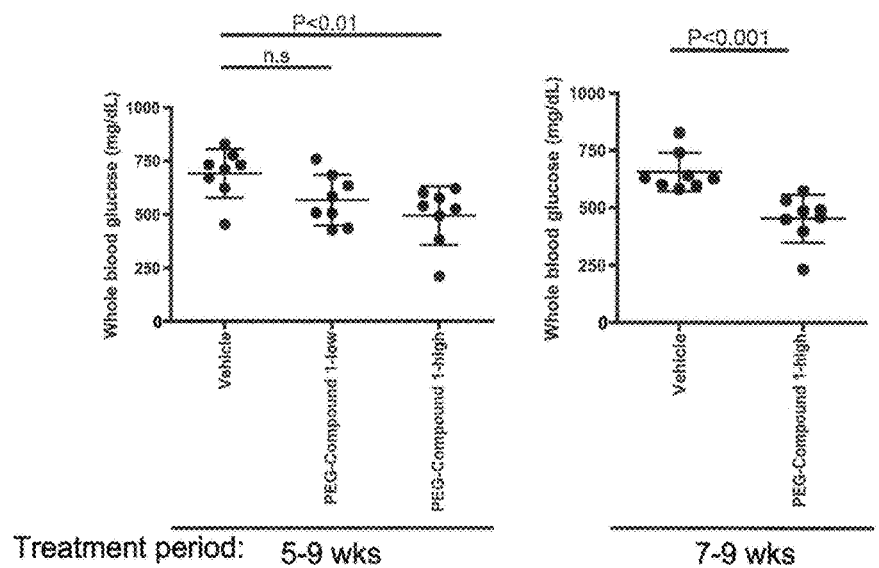
FIG. 25. Plasma ALT
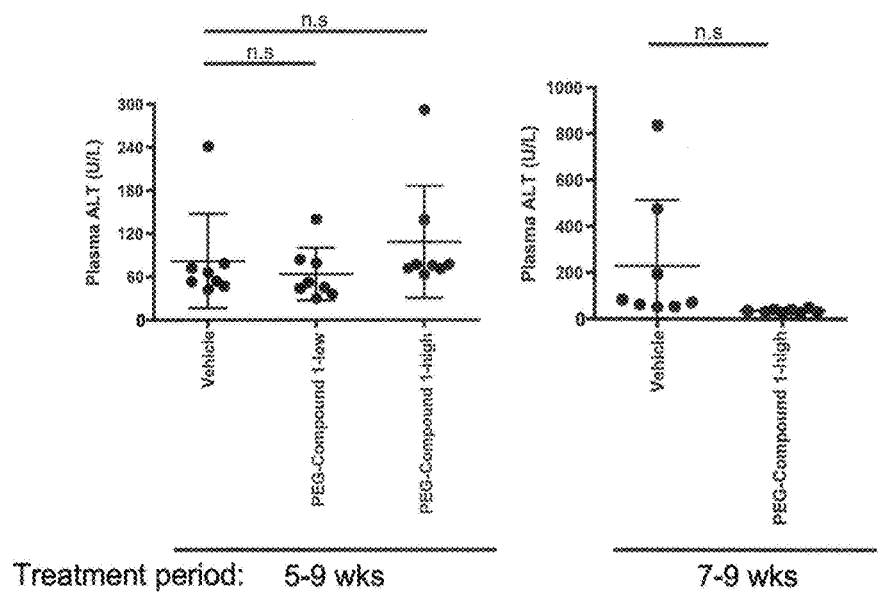

FIG. 26. Plasma triglyceride
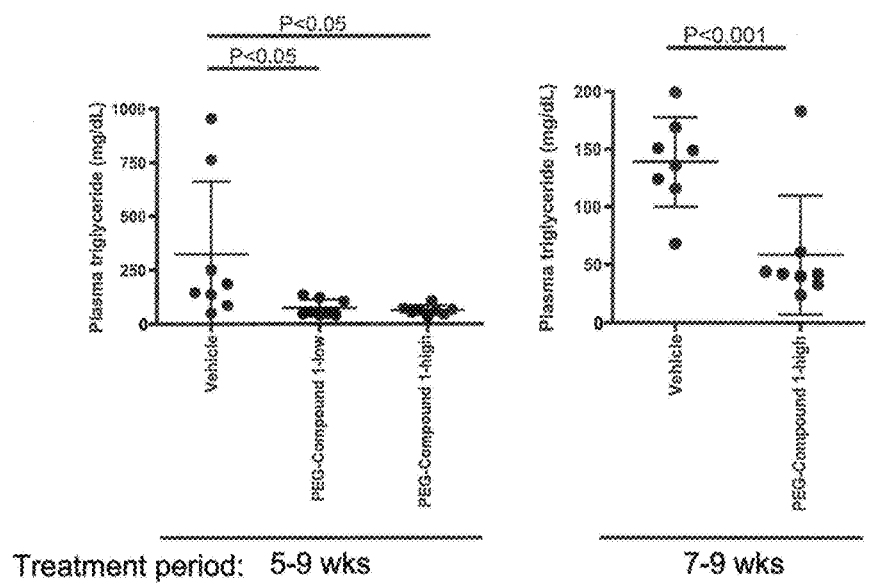
FIG. 27. Plasma total cholesterol
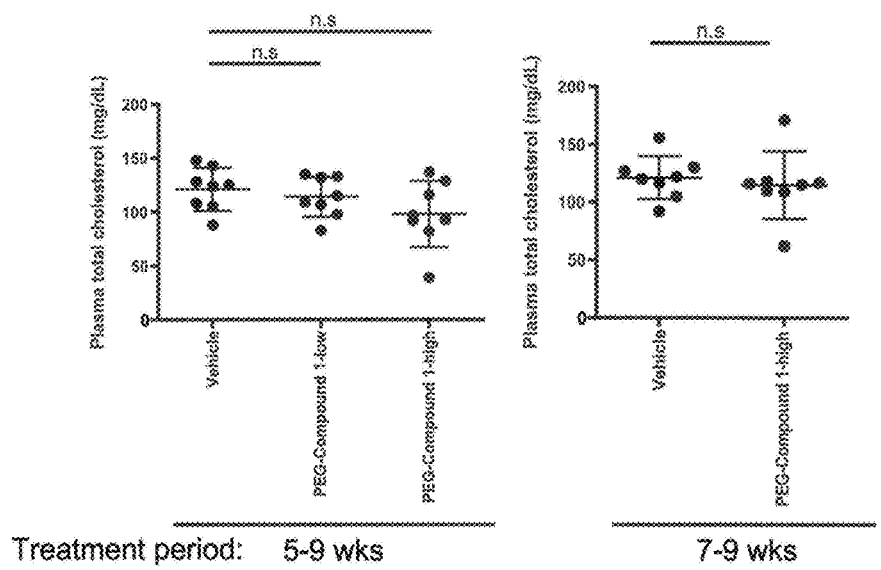

FIG. 28. Liver triglyceride
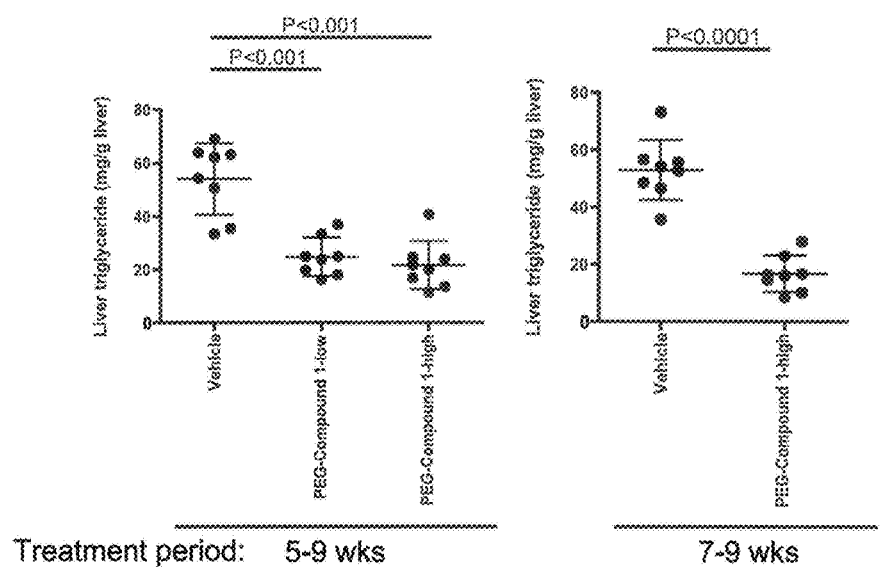
FIG. 29. Liver cholesterol
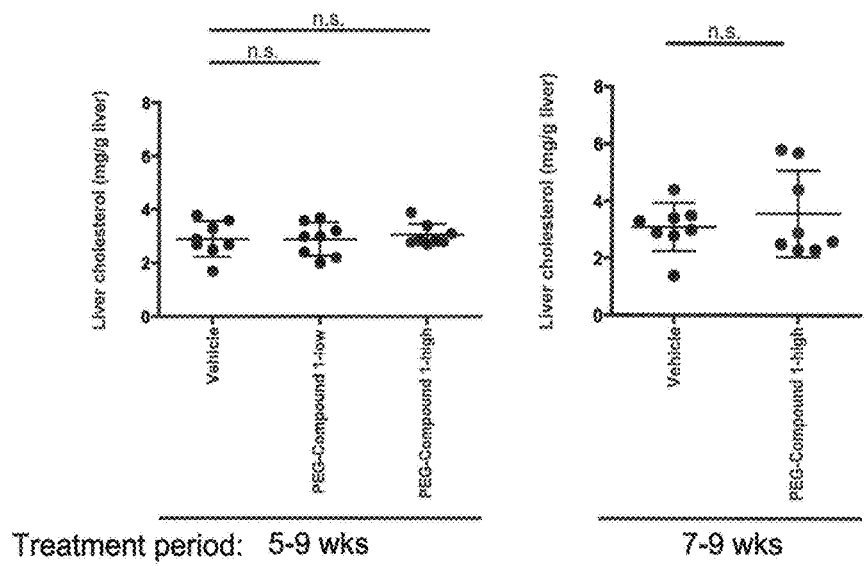

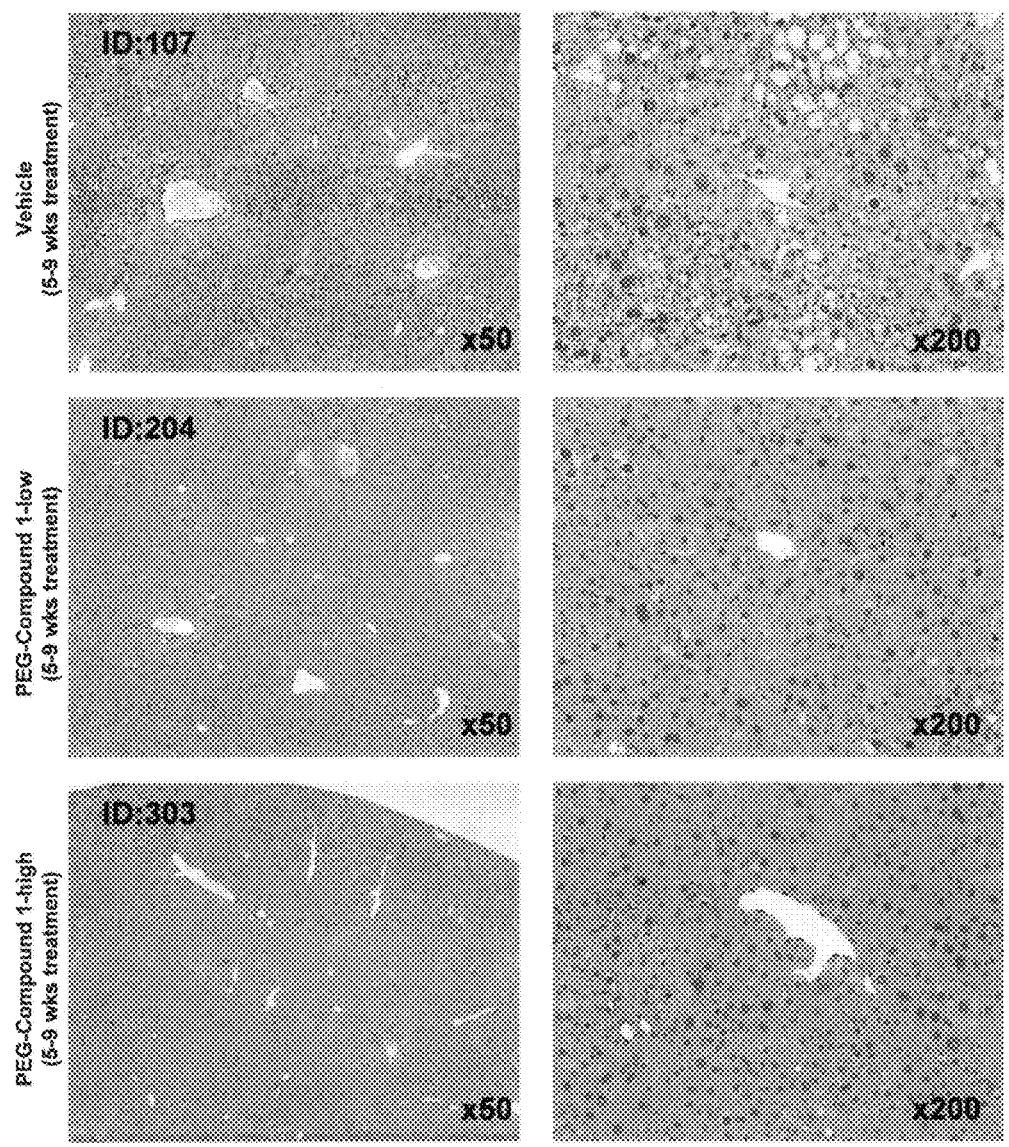
FIG. 30A. Representative photomicrographs of HE-stained liver sections

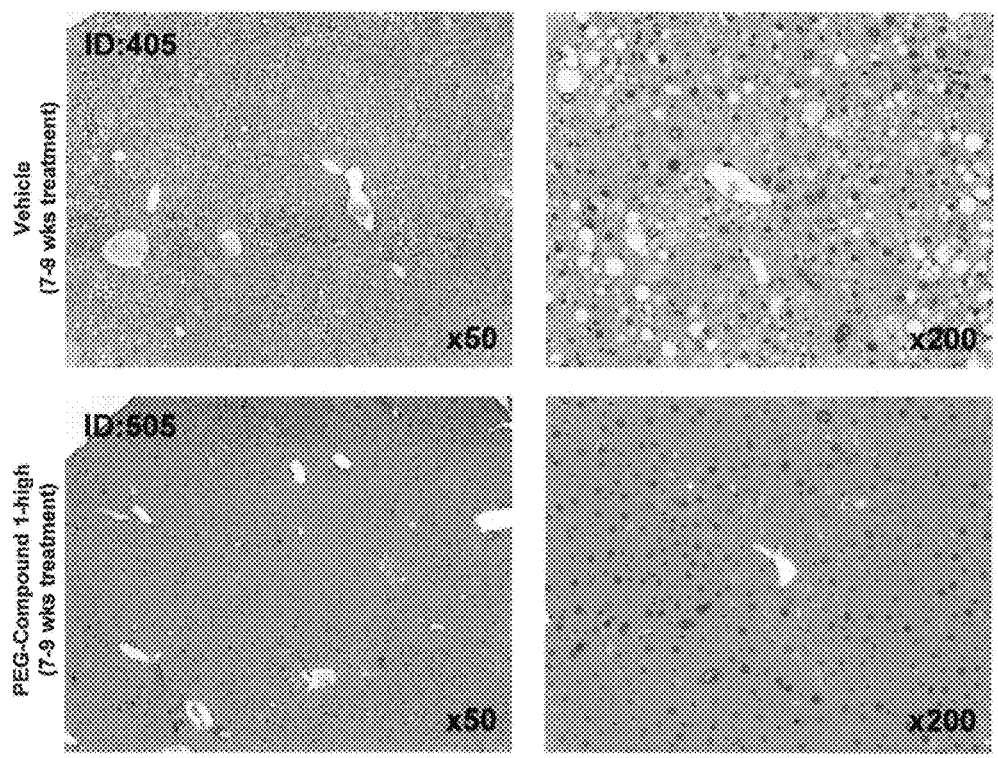
FIG. 30B. Representative photomicrographs of HE-stained liver sections (continued)

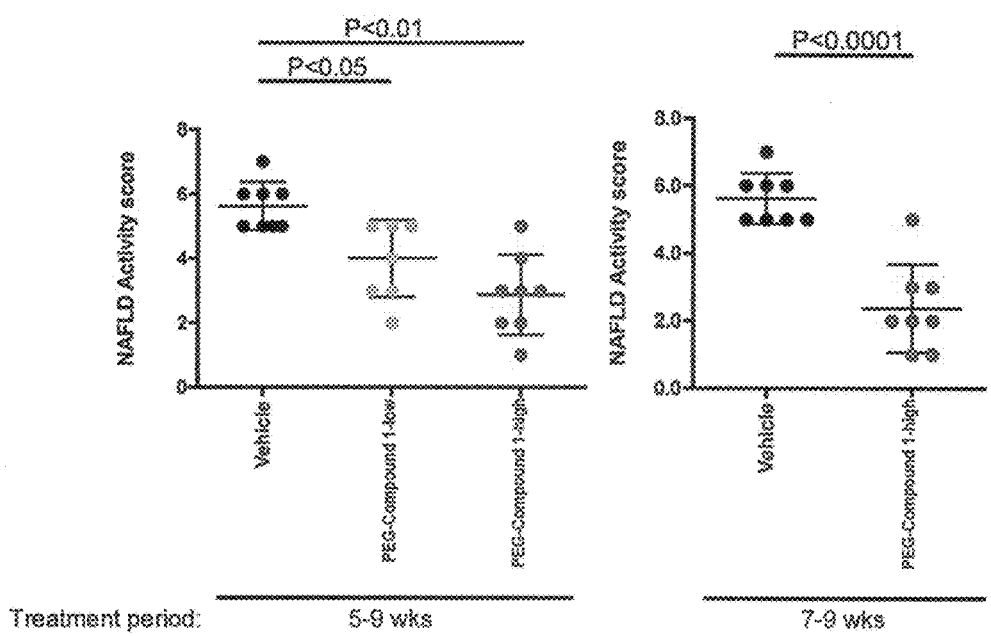
FIG. 31. NAFLD Activity score

FIG. 32A. Steatosis score
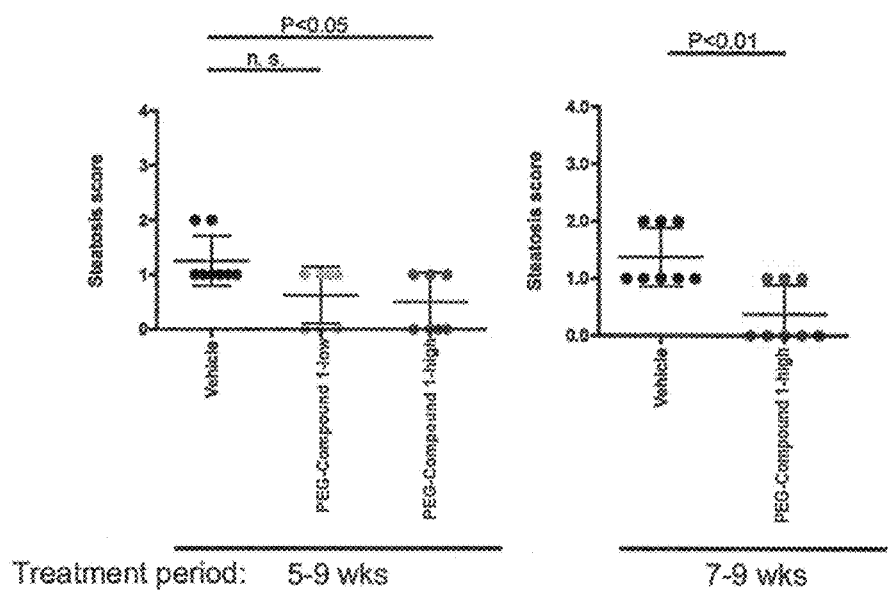
FIG. 32B. Lobular inflammation score
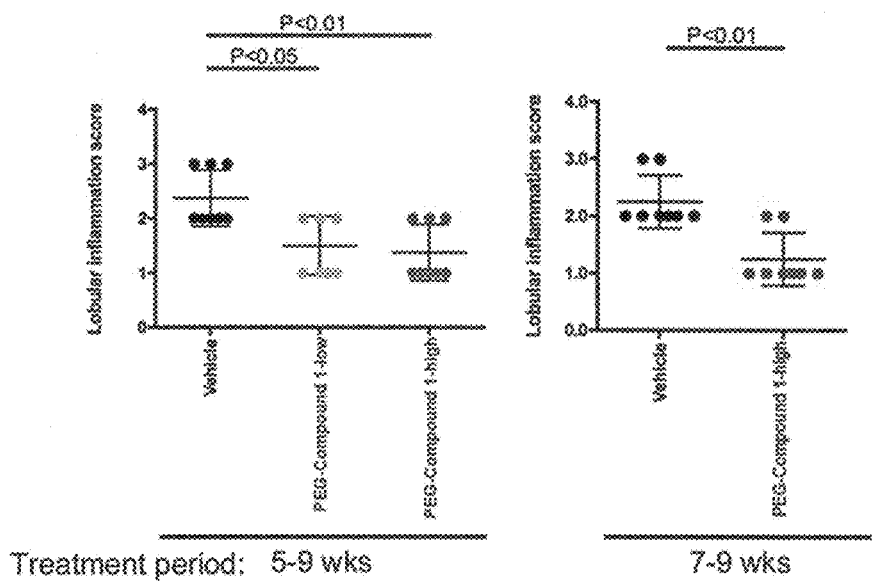

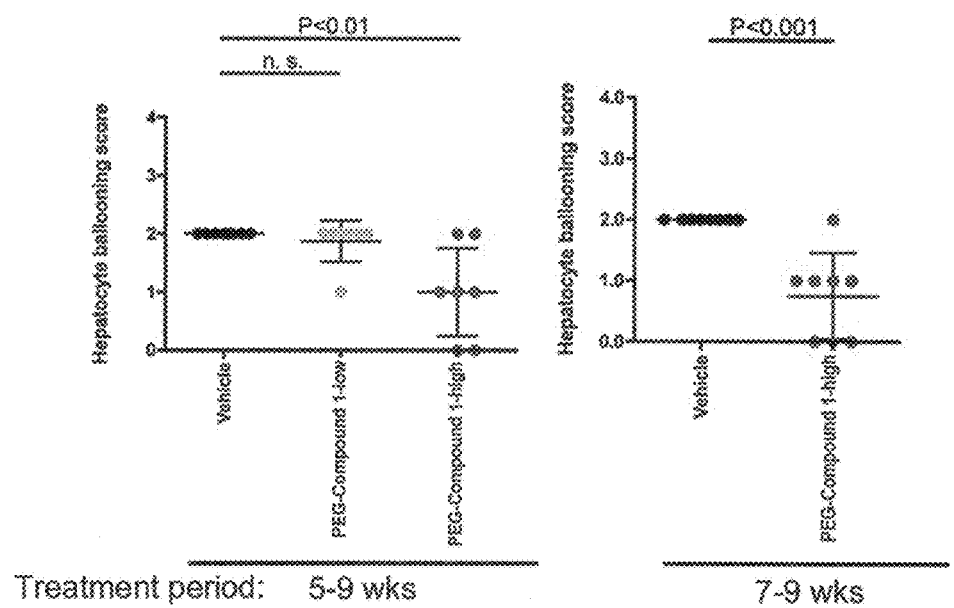
FIG. 32C. Hepatocyte ballooning score

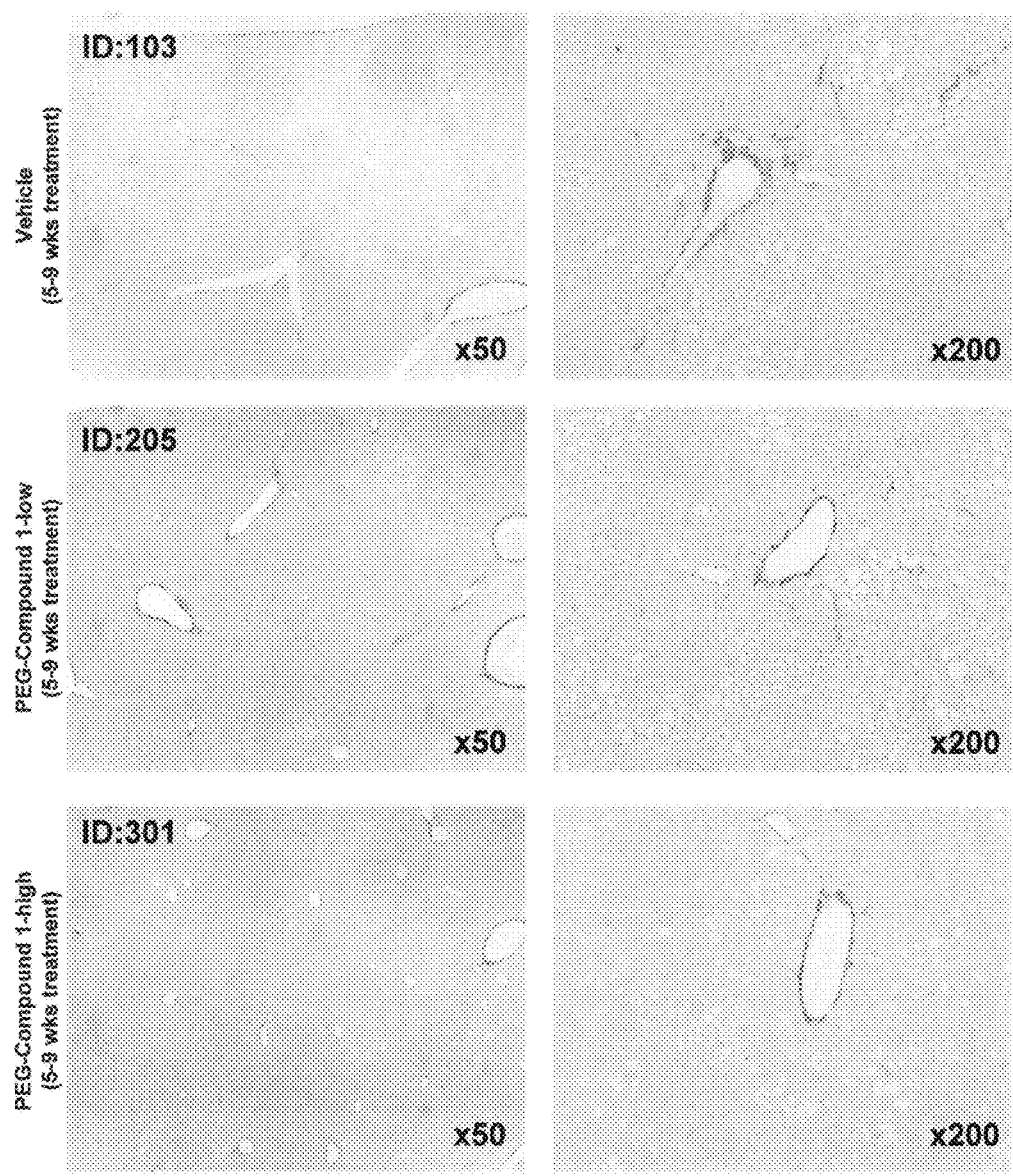
FIG. 33A. Representative photomicrographs of Sirius red-stained liver sections

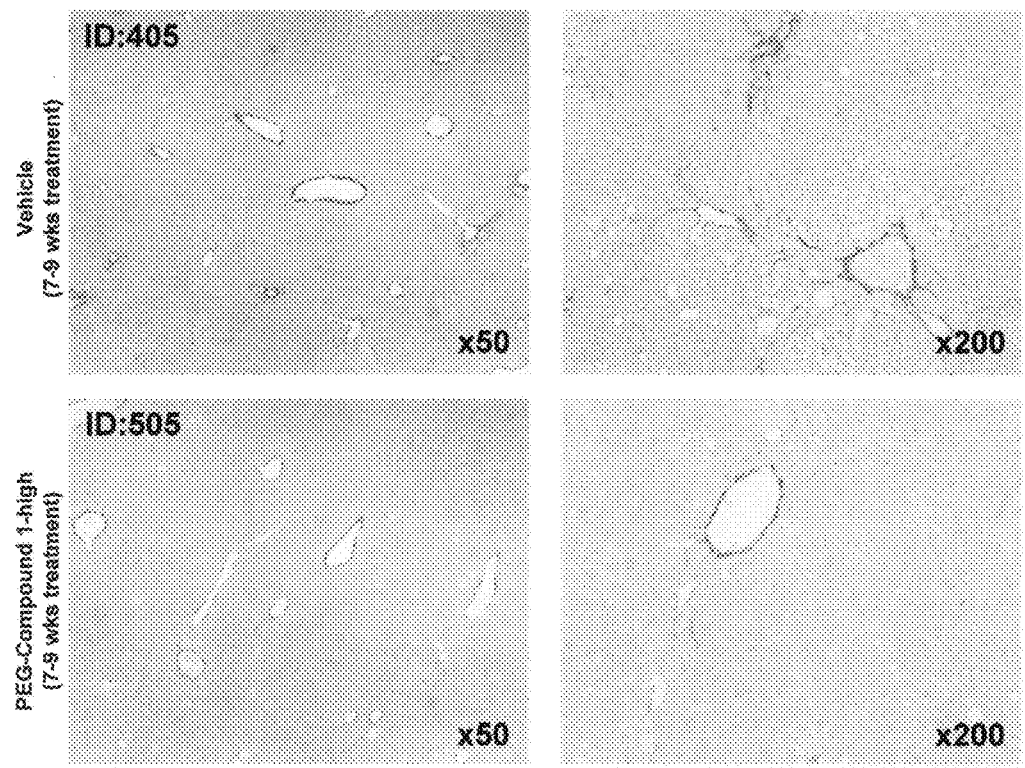
FIG. 33B. Representative photomicrographs of Sirius red-stained liver sections (continued)

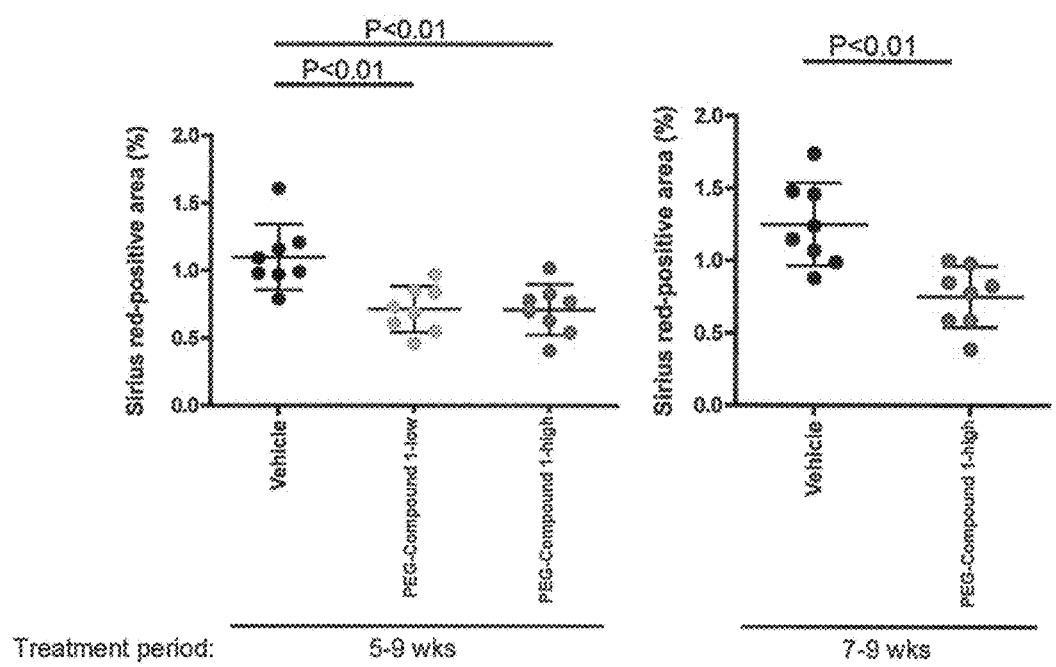
FIG. 34. Fibrosis area

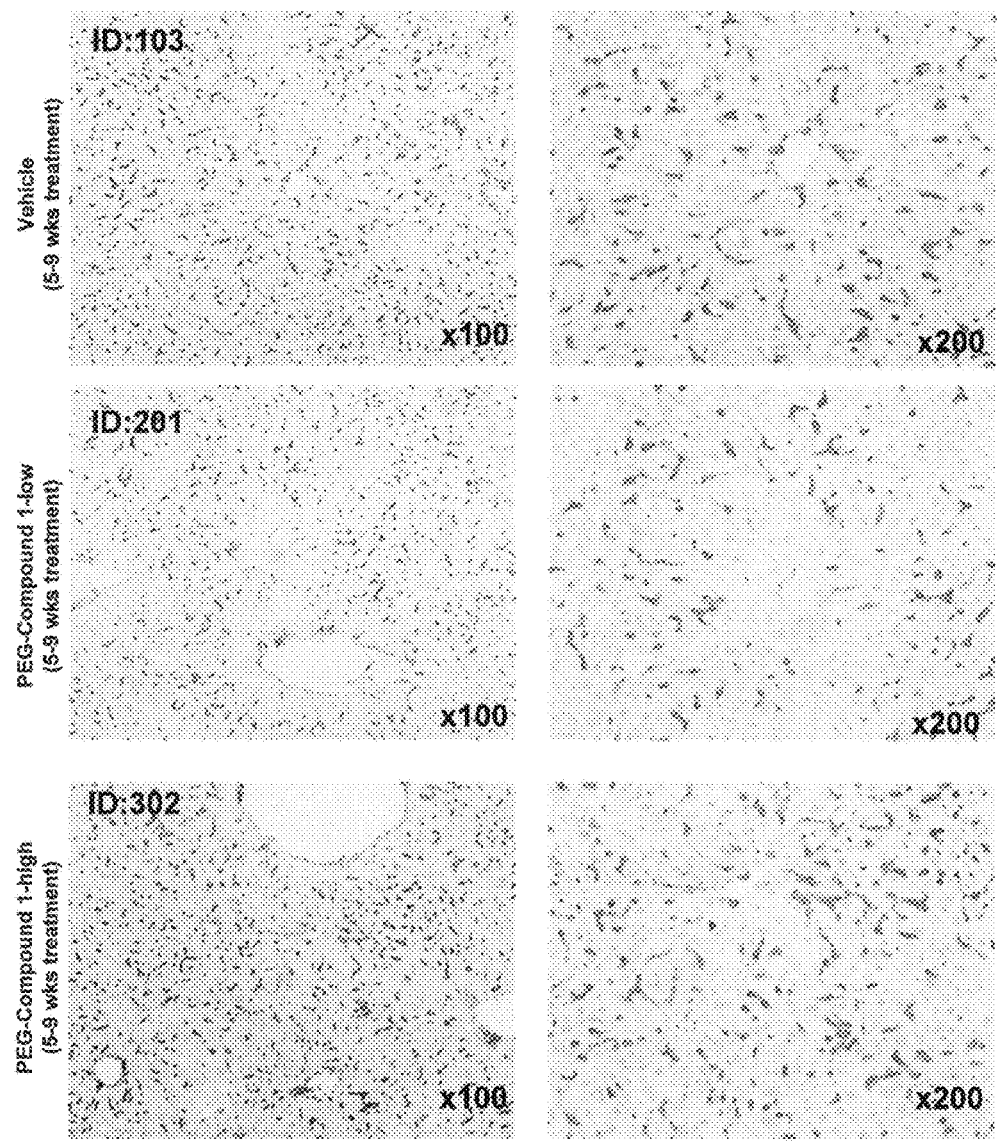
FIG. 35A. Representative photomicrographs of F4/80-immunostained liver sections

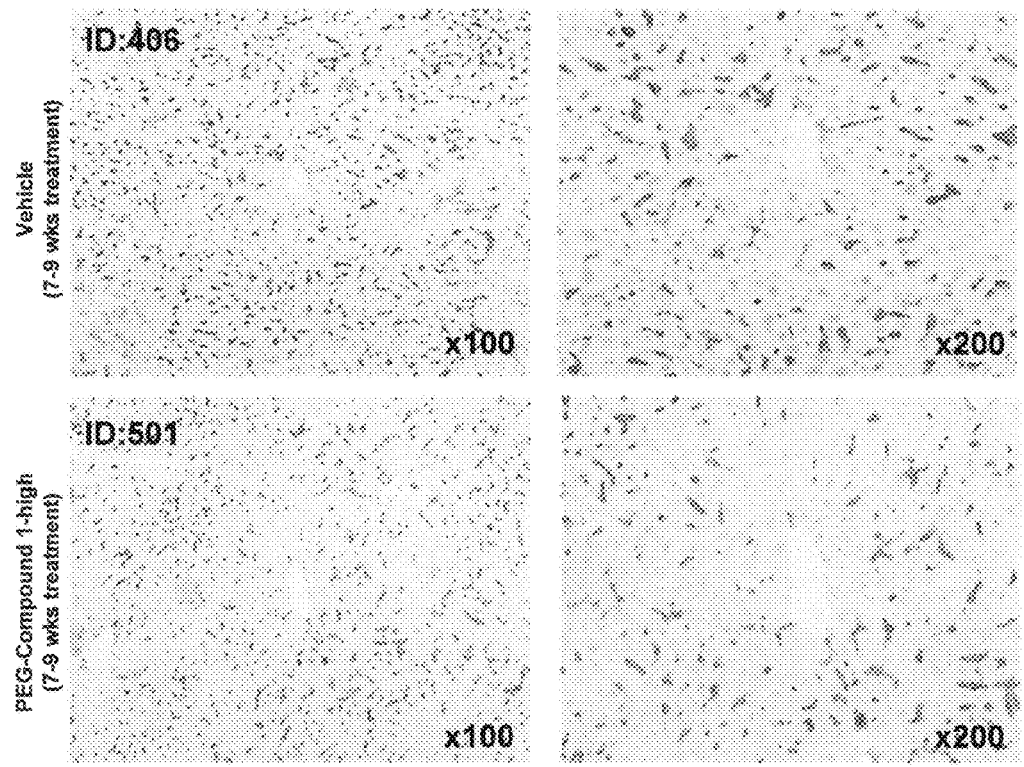
FIG. 35B. Representative photomicrographs of F4/80-immunostained liver sections (continued)

FIG. 36. Inflammation area
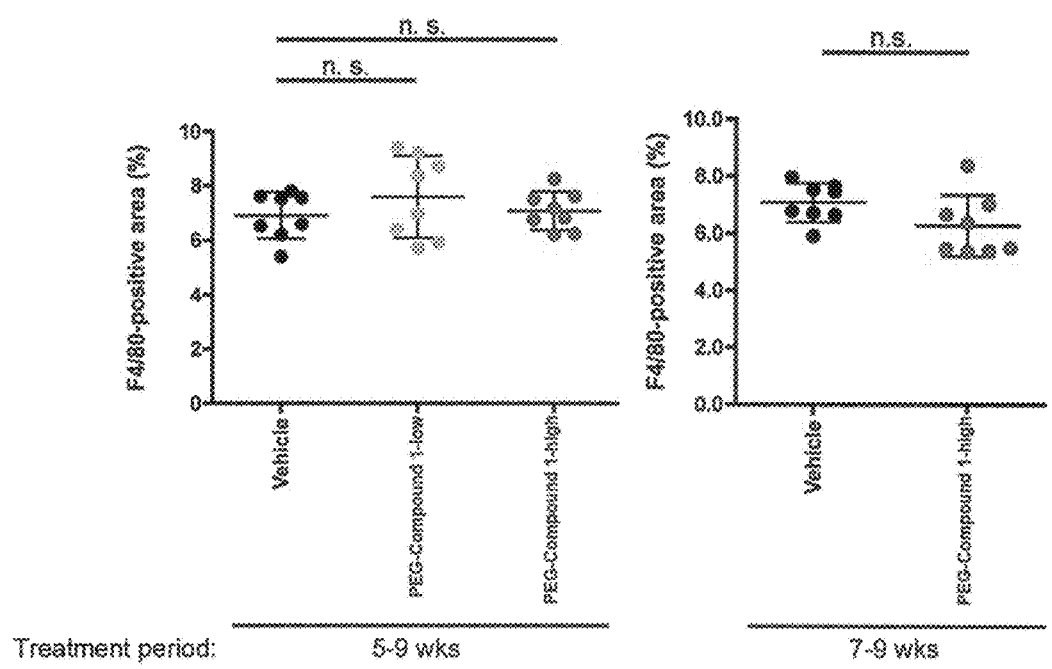

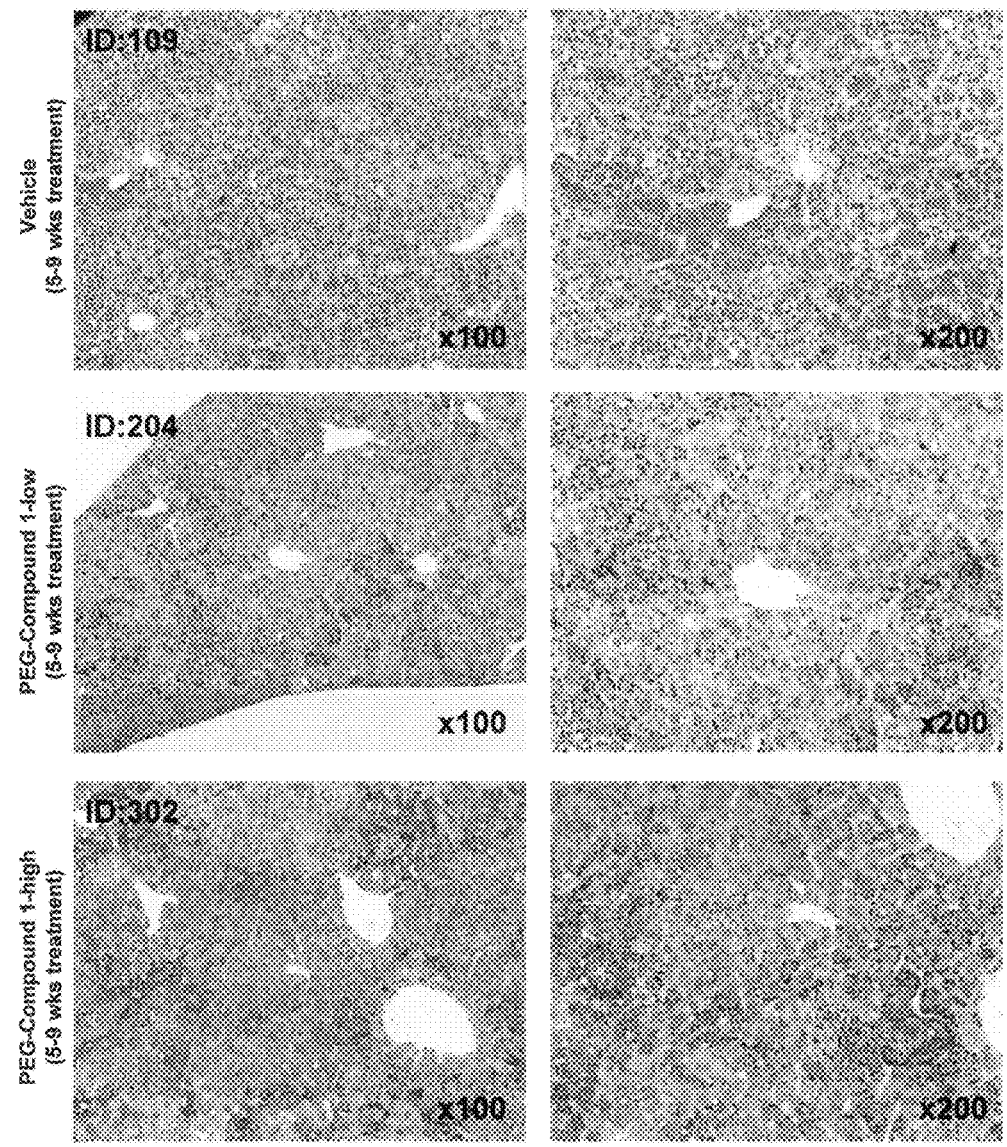
FIG. 37A. Representative photomicrographs of Oil red-stained liver sections

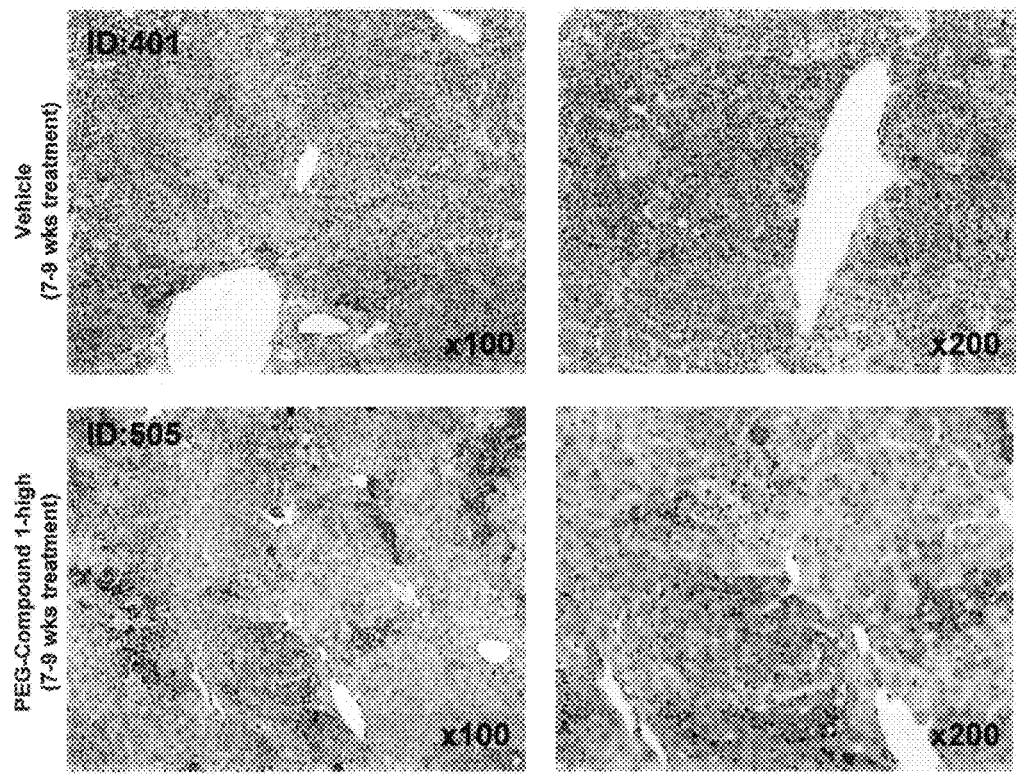
FIG. 37B. Representative photomicrographs of Oil red-stained liver sections (continued)

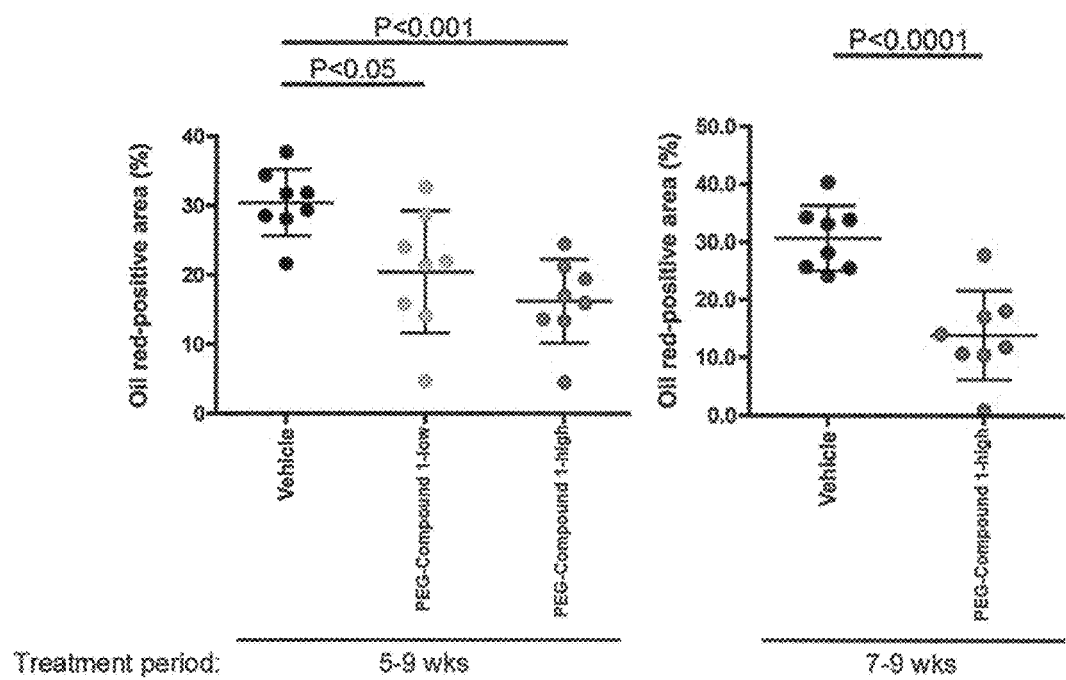
FIG. 38. Fat deposition area

Alpha-SMA

TIMP-1

Collagen Type 1

Treatment period: 5-9 wks    7-9 wks

TGF-β

5-9 wks    7-9 wks

FIG. 40A. Modified FGF-21 Polypeptide Fusion Proteins

| Compound Name | SEQ ID NO: | Fusion Arrangement | Connecting Peptide | SEQ ID NO: |
|---|---|---|---|---|
| Compound 101 | 401 | PKE(2)-L1-FGF21(Cmp. 2) | GS | 354 |
| Compound 102 | 402 | PKE(2)-L2-FGF21(Cmp. 2) | GGGGS | 355 |
| Compound 103 | 403 | PKE(2)-L3-FGF21(Cmp. 2) | EEEDEEED | 356 |
| Compound 104 | 404 | PKE(2)-L4-FGF21(Cmp. 2) | PSPEPPTPEP | 357 |
| Compound 105 | 405 | PKE(2)-L5-FGF21(Cmp. 2) | GSHHHHHHGS | 358 |
| Compound 106 | 406 | PKE(2)-L6-FGF21(Cmp. 2) | GGGGSGGGGSGGGGS | 359 |
| Compound 107 | 407 | PKE(2)-L7-FGF21(Cmp. 2) | GGGGSGGGGSGGGGS | 360 |
| Compound 108 | 408 | PKE(2)-L8-FGF21(Cmp. 2) | GSGSGSGSGSGSGS | 361 |
| Compound 109 | 409 | PKE(2)-L9-FGF21(Cmp. 2) | PSTPFTPSPSTPPTPSPS | 362 |
| Compound 110 | 410 | PKE(2)-L10-FGF21(Cmp. 2) | RGGEEKKKEKEKEEQEERETKTP | 363 |
| Compound 111 | 411 | PKE(2)-L11-FGF21(Cmp. 2) | GGGGSGGGSGGGGSGGGGSGGGGS | 364 |
| Compound 112 | 412 | PKE(2)-L12-FGF21(Cmp. 2) | PSPEPPTPEPPSPEPPTPEPPSPEPPTPEP | 365 |
| Compound 113 | 413 | PKE(2)-L13-FGF21(Cmp. 2) | PSTPPTPSPSTPPTPSPSTPPTPSPSTPPTPSPS | 366 |
| Compound 114 | 414 | PKE(2)-L14-FGF21(Cmp. 2) | PSPEP | 367 |
| Compound 115 | 415 | PKE(2)-L15-FGF21(Cmp. 2) | PSPEPPTPEPPSPEPPTPEP | 368 |
| Compound 116 | 416 | PKE(2)-L16-FGF21(Cmp. 2) | PSPEPPTPEPPSPEPPTPEPPSPEPPTPEPPSPEPPTPEP | 369 |
| Compound 117 | 417 | PKE(2)-L17-FGF21(Cmp. 2) | PTPEPPSPEPPTPEPPSPEP | 370 |
| Compound 118 | 418 | PKE(2)-L18-FGF21(Cmp. 2) | PSPEPGGGSPTPEP | 371 |
| Compound 119 | 419 | PKE(2)-L19-FGF21(Cmp. 2) | PSPEPEEEDPTPEP | 372 |
| Compound 120 | 420 | PKE(2)-L20-FGF21(Cmp. 2) | PSPEPPTPEPEEEDPSPEPPTPEP | 373 |
| Compound 121 | 421 | PKE(2)-L21-FGF21(Cmp. 2) | PTPEPPSPEPPTPEPEEEDPSPEPPTPEPPSPEP | 374 |
| Compound 122 | 422 | PKE(2)-L22-FGF21(Cmp. 2) | PTPEPPSPEPPTPEPGGGGSPSPEPPTPEPPSPEP | 375 |
| Compound 123 | 423 | PKE(2)-L23-FGF21(Cmp. 2) | PSPEPPTPEPSPEPPTPEPSPEPTPEP | 376 |

FIG. 40B.

| Compound Name | SEQ ID NO: | Fusion Arrangement | Connecting Peptide | SEQ ID NO: |
|---|---|---|---|---|
| Compound 124 | 424 | HuSA(C34A)-L201-FGF21(Cmp. 2) | GS | 354 |
| Compound 125 | 425 | HuSA(C34A)-L202-FGF21(Cmp. 2) | GGGGS | 355 |
| Compound 126 | 426 | HuSA(C34A)-L203-FGF21(Cmp. 2) | GETGS | 377 |
| Compound 127 | 427 | HuSA(C34A)-L204-FGF21(Cmp. 2) | GGGGSGGGGS | 378 |
| Compound 128 | 428 | HuSA(C34A)-L205-FGF21(Cmp. 2) | GETGSSGEGT | 379 |
| Compound 129 | 429 | HuSA(C34A)-L206-FGF21(Cmp. 2) | GGGGSGGGGSGGGGS | 359 |
| Compound 130 | 430 | HuSA(C34A)-L207-FGF21(Cmp. 2) | GETGSSGEGTGSTGS | 380 |
| Compound 131 | 431 | HuSA(C34A)-L208-FGF21(Cmp. 2) | GGGGSGGGGSGGGGSGGGGS | 381 |
| Compound 132 | 432 | HuSA(C34A)-L209-FGF21(Cmp. 2) | GETGSSGEGTGSTGSGAGES | 382 |
| Compound 133 | 434 | HuSA(C34A, des Leu-585)-L211-FGF21(Cmp. 2) | GGGGSGGGGSGGGGS | 359 |
| Compound 134 | 435 | HuSA(C34A, des Leu-585)-L207-FGF21(Cmp. 2) | GETGSSGEGTGSTGS | 380 |
| Compound 135 | 436 | HuSA(C34A, des Leu-585)-L211-FGF21(Cmp. 1) | GGGGSGGGGSGGGGS | 359 |
| Compound 136 | 437 | HuSA(C34A, des Leu-585)-L207-FGF21(Cmp. 1) | GETGSSGEGTGSTGS | 380 |
| Compound 137 | 440 | FGF21(Cmp. 2)-L205-HuSA(C34A) | GETGSSGEGT | 379 |
| Compound 138 | 441 | FGF21(Cmp. 2)-L209-HuSA(C34A) | GETGSSGEGTGSTGSGAGES | 382 |
| Compound 139 | 442 | FGF21(Cmp. 2)-L210-HuSA(C34A) | GETGSSGEGTGSTGSGAGESGTGESGEGGS | 383 |
| Compound 140 | 443 | FGF21(Cmp. 1)-L209-HuSA(C34A) | GETGSSGEGTGSTGSGAGES | 382 |
| Compound 141 | 446 | FGF21(Cmp. 2)-L209-HuSA(C34A)-G4Sx3-FGF21(Cmp. 2) | GETGSSGEGTGSTGSGAGES | 382 |
| Compound 142 | 447 | FGF21(Cmp. 1)-L209-HuSA(C34A)-G4Sx3-FGF21(Cmp. 1) | GETGSSGEGTGSTGSGAGES | 382 |
| Compound 143 | 448 | FGF21(Cmp. 2)-L209-HuSA(C34A, des Leu-585)-G4Sx3-FGF21(Cmp. 2) | GETGSSGEGTGSTGSGAGES | 382 |
| Compound 144 | 449 | FGF21(Cmp. 1)-L209-HuSA(C34A, des Leu-585)-G4Sx3-FGF21(Cmp. 1) | GETGSSGEGTGSTGSGAGES | 382 |
| Compound 145 | 450 | FGF21(Cmp. 2)-L210-HuSA(C34A)-G4Sx3-FGF21(Cmp. 2) | GETGSSGEGTGSTGSGAGESGTGESGEGGS | 383 |
| Compound 146 | 451 | FGF21(Cmp. 1)-L210-HuSA(C34A)-G4Sx3-FGF21(Cmp. 1) | GETGSSGEGTGSTGSGAGESGTGESGEGGS | 383 |

FIG. 40C

| Compound Name | SEQ ID NO: | Fusion Arrangement | Connecting Peptide | SEQ ID NO: |
|---|---|---|---|---|
| Compound 147 | 452 | PKE(1)-L1-FGF21(Cmp. 2) | GS | 354 |
| Compound 148 | 453 | PKE(1)-L2-FGF21(Cmp. 2) | GGGGS | 355 |
| Compound 149 | 454 | PKE(1)-L3-FGF21(Cmp. 2) | EEEEDEEEED | 356 |
| Compound 150 | 455 | PKE(1)-L4-FGF21(Cmp. 2) | PSPEPPTPEP | 357 |
| Compound 151 | 456 | PKE(1)-L5-FGF21(Cmp. 2) | GSHHHHHHHGS | 358 |
| Compound 152 | 457 | PKE(1)-L6-FGF21(Cmp. 2) | GGGGSGGGGSGGGGS | 359 |
| Compound 153 | 458 | PKE(1)-L7-FGF21(Cmp. 2) | GGGGSGGGGSGGGGS | 360 |
| Compound 154 | 459 | PKE(1)-L8-FGF21(Cmp. 2) | GSGSGSGSGSGSGS | 361 |
| Compound 155 | 460 | PKE(1)-L9-FGF21(Cmp. 2) | PSTPPTPSPSTPPTPSPS | 362 |
| Compound 156 | 461 | PKE(1)-L10-FGF21(Cmp. 2) | RGGEEKKKEKEKEEQEERETKTP | 363 |
| Compound 157 | 462 | PKE(1)-L11-FGF21(Cmp. 2) | GGGGSGGGGSGGGGSGGGGSGGGGS | 364 |
| Compound 158 | 463 | PKE(1)-L12-FGF21(Cmp. 2) | PSPEPPTPEPPSPEPPTPEPPSPEPPTPEP | 365 |
| Compound 159 | 464 | PKE(1)-L13-FGF21(Cmp. 2) | PSTPPTPSPSTPPTPSPSTPPTPSPSTPPTPSPS | 366 |
| Compound 160 | 465 | PKE(1)-L14-FGF21(Cmp. 2) | PSPEP | 367 |
| Compound 161 | 466 | PKE(1)-L15-FGF21(Cmp. 2) | PSPEPPTPEPPSPEPPTPEP | 368 |
| Compound 162 | 467 | PKE(1)-L16-FGF21(Cmp. 2) | PSPEPPTPEPPSPEPPTPEPPSPEPPTPEPPSPEPPTPEP | 369 |
| Compound 163 | 468 | PKE(1)-L17-FGF21(Cmp. 2) | PTPEPPSPEPPTPEPPSPEP | 370 |
| Compound 164 | 469 | PKE(1)-L18-FGF21(Cmp. 2) | PSPEPGGGSPTPEP | 371 |
| Compound 165 | 470 | PKE(1)-L19-FGF21(Cmp. 2) | PSPEPEEEDPTPEP | 372 |
| Compound 166 | 471 | PKE(1)-L20-FGF21(Cmp. 2) | PSPEPPTPEPEEEDPSPEPPTPEP | 373 |
| Compound 167 | 472 | PKE(1)-L21-FGF21(Cmp. 2) | PTPEPPSPEPPTPEPEEEDPSPEPPTPEPPSPEP | 374 |
| Compound 168 | 473 | PKE(1)-L22-FGF21(Cmp. 2) | PTPEPPSPEPPTPEPGGGSPSPEPPTPEPPSPEP | 375 |
| Compound 169 | 474 | PKE(1)-L23-FGF21(Cmp. 2) | PSPEPPTPEPSPEPPTPEPSPEPTPEP | 376 |

FIG. 40D

| Compound Name | SEQ ID NO: | Fusion Arrangement | Connecting Peptide | SEQ ID NO: |
|---|---|---|---|---|
| Compound 170 | 475 | Fc(hIgG1a_191)-L7-FGF21(Cmp. 2) | GGGGSGGGSGGGGS | 360 |
| Compound 171 | 476 | Fc(hIgG1a_191)-L250-FGF21(Cmp. 2) | GGGGSGGGGSGGGGSGGGGSGGGGSGGGGSGGGGS | 350 |
| Compound 172 | 477 | Fc(hIgG1a_191)-L12-FGF21(Cmp. 2) | PSPEPPTPEPPSPEPPTPEPPSPEPPTPEP | 365 |
| Compound 173 | 478 | Fc(hIgG1a_191)-L251-FGF21(Cmp. 2) | PSPEPPTPEPPSPEP | 351 |
| Compound 174 | 479 | Fc(hIgG1a_191)-L5-FGF21(Cmp. 2) | GSHHHHHHHGS | 358 |
| Compound 175 | 480 | Fc(hIgG1a_191)-L252-FGF21(Cmp. 2) | ELQLEESAAEAQEGELE | 352 |
| Compound 176 | 481 | Fc(hIgG1a_190)-L253-FGF21(Cmp. 2) | SSGGGGSGGGGSGGGGS | 353 |
| Compound 177 | 482 | Fc(hIgG1a_191)-L6-FGF21(Cmp. 2) | GGGGSGGGGSGGGGS | 359 |
| Compound 178 | 483 | Fc(hIgG1a_189)-L6-FGF21(Cmp. 2) | GGGGSGGGGSGGGGS | 359 |
| Compound 179 | 484 | Fc(hIgG1a_191)-L7-FGF21-1aa(Cmp. 2) | GGGGSGGGGSGGGGS | 360 |
| Compound 180 | 485 | Fc(hIgG1a_191)-L7-FGF21-3aa(Cmp. 2) | GGGGSGGGGSGGGGS | 360 |
| Compound 181 | 486 | Fc(hIgG1f_11_186)-L7-FGF21 (Cmp. 2) | GGGGSGGGGSGGGGS | 360 |
| Compound 182 | 487 | Fc(hIgG1a_191b)-L7-FGF21(Cmp. 2) | GGGGSGGGGSGGGGS | 360 |

FIG. 42A  n.s.   FIG. 42B  n.s.
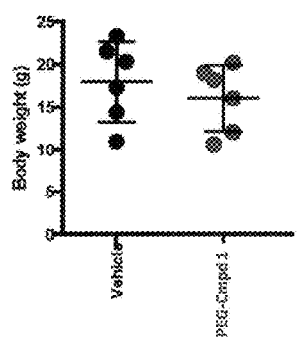 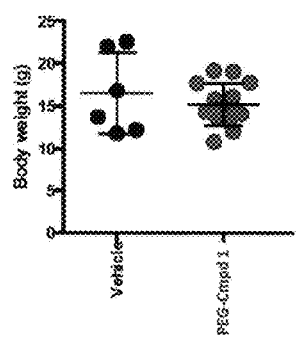
Treatment Period:  9-12 wks  9-15 wks
FIG. 43A  n.s.   FIG. 43B  p<0.001
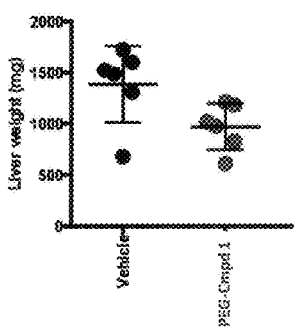 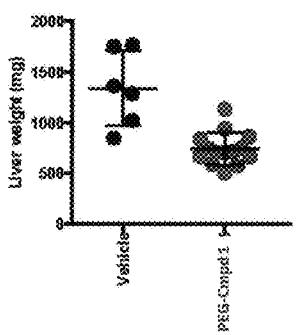
Treatment Period:  9-12 wks  9-15 wks FIG. 44 A   p<0.01          FIG. 44 B   p<0.001
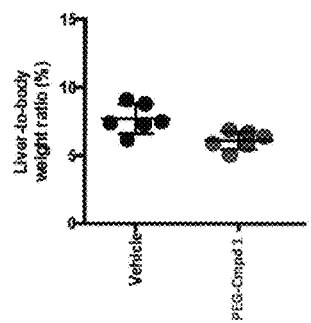 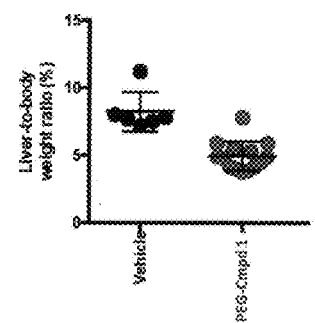
Treatment Period:   9-12 wks                9-15 wks
FIG. 45 A   n.s.            FIG. 45 B   n.s.
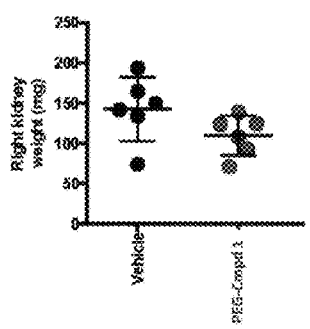 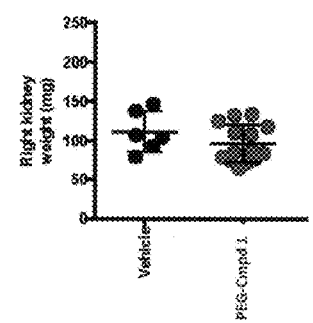
Treatment Period:   9-12 wks                9-15 wks Treatment Period: 9-12 wks | 9-15 wks

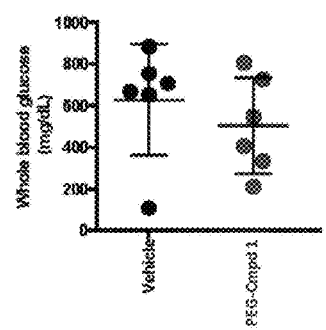
FIG. 47A  n.s.
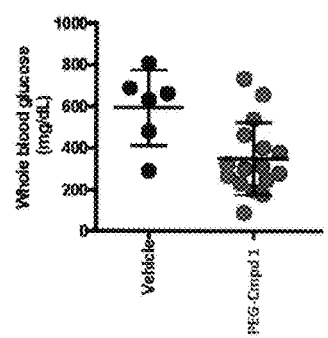
FIG. 47B  p<0.05
Treatment Period: 9-12 wks    9-15 wks
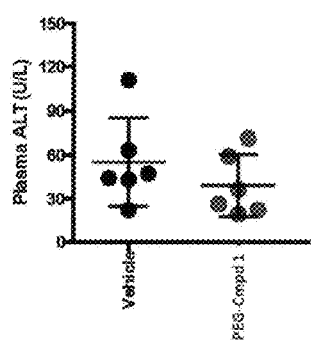
FIG. 48A  n.s.
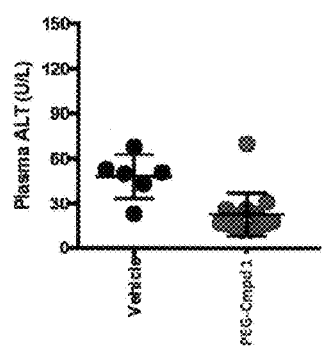
FIG. 48B  p<0.01
Treatment Period: 9-12 wks    9-15 wks

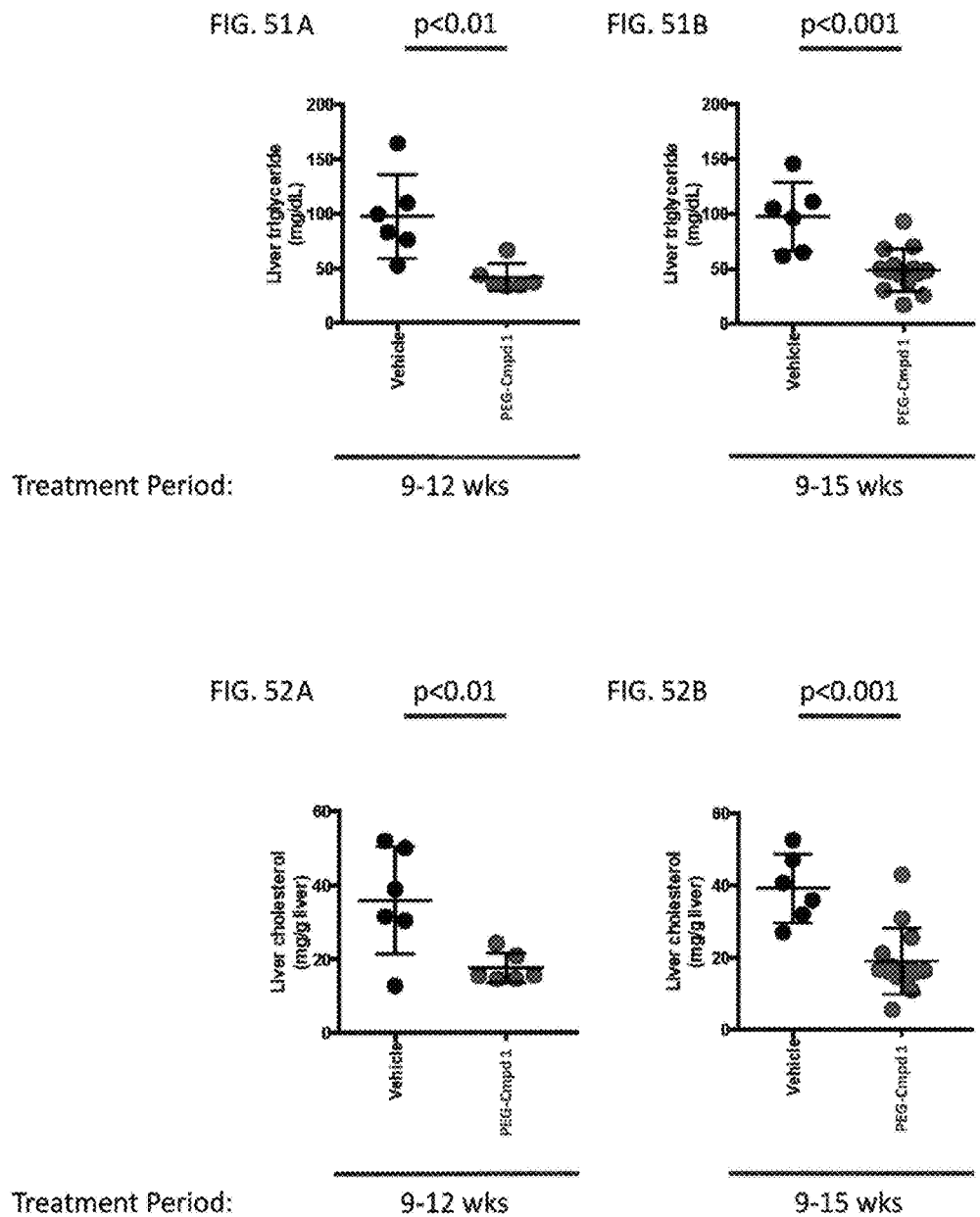

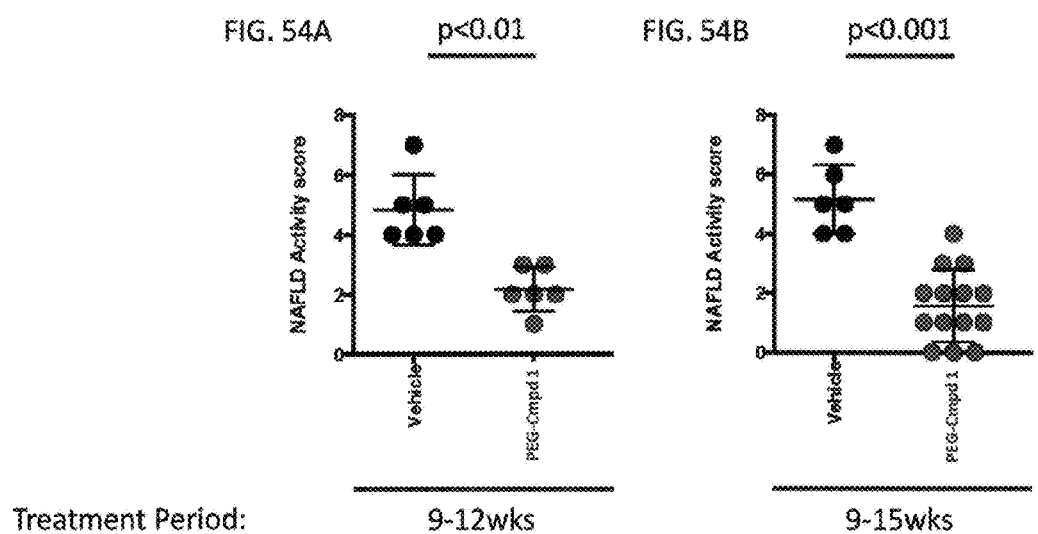

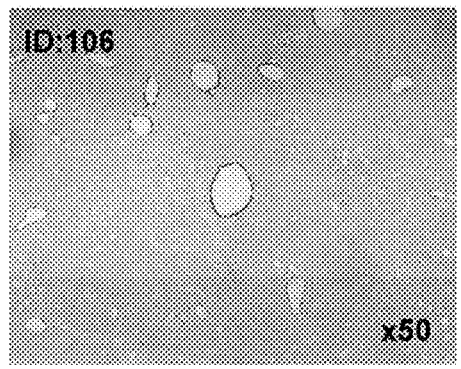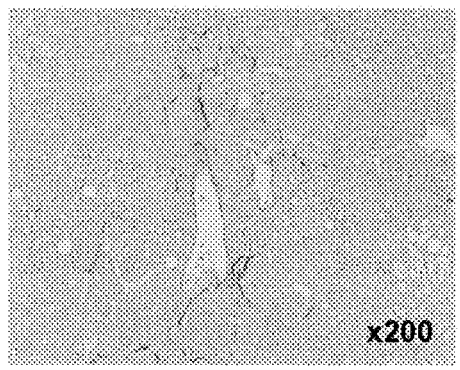
FIG. 55A　　　　　　　　　　FIG. 55B
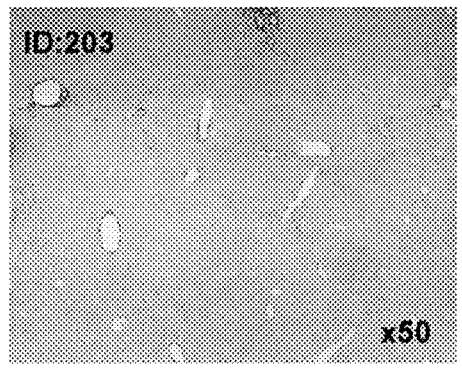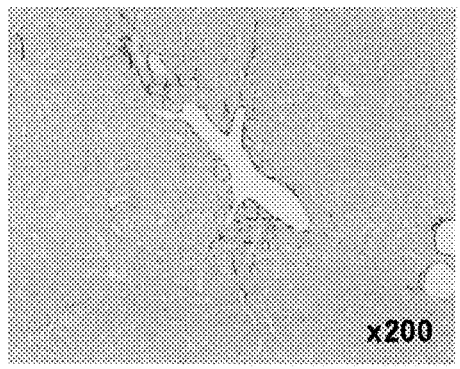
FIG. 55C　　　　　　　　　　FIG. 55D

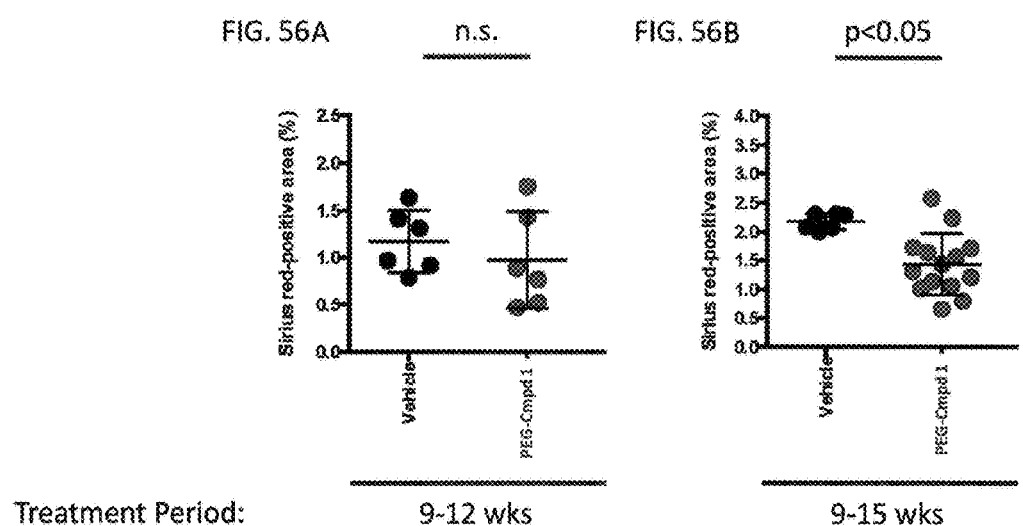

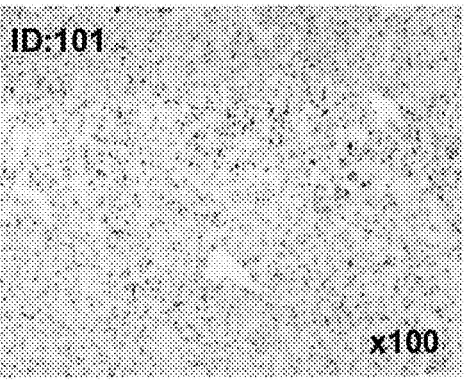
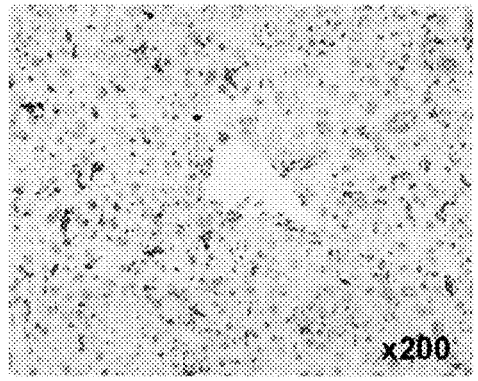
FIG. 57A                FIG. 57B
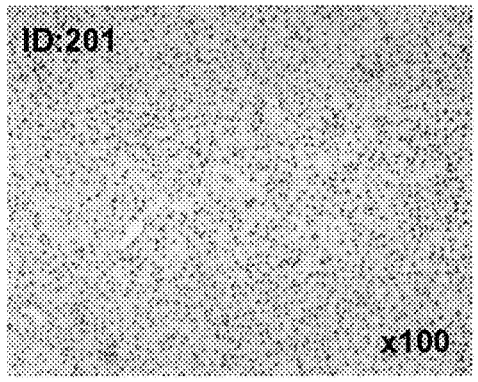
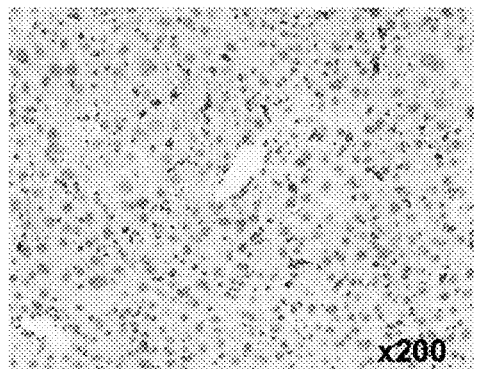
FIG. 57C                FIG. 57D

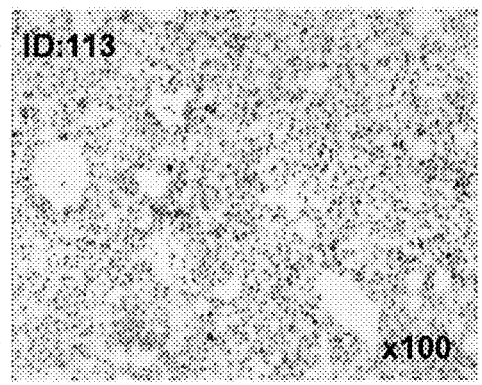
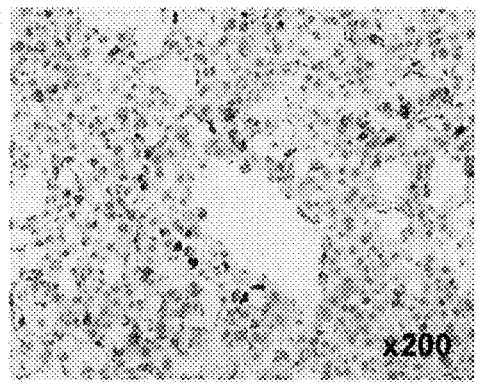
FIG. 57E  FIG. 57F
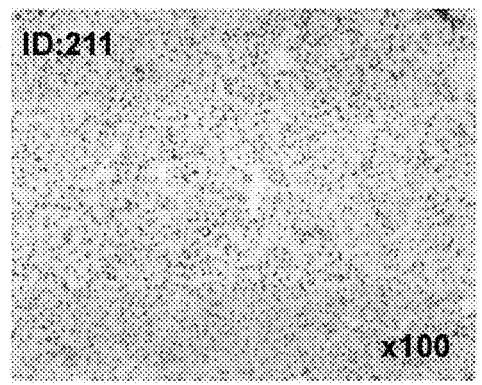
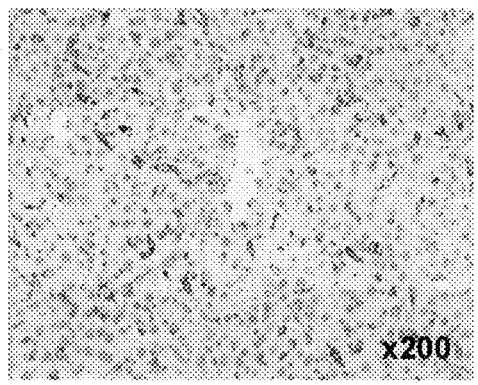
FIG. 57G  FIG. 57H

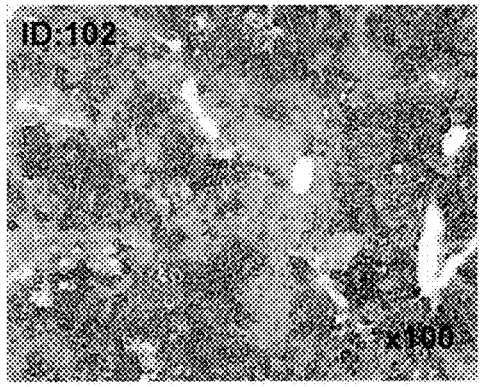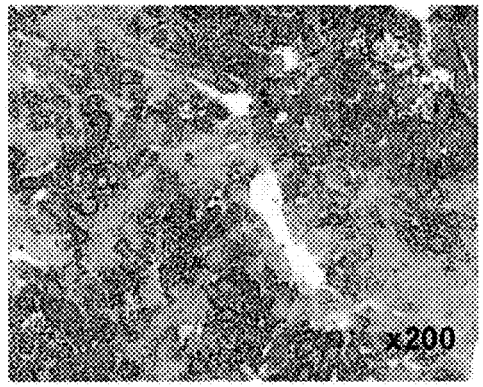
FIG. 59A  FIG. 59B
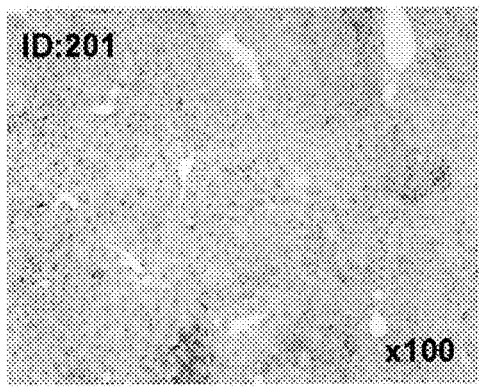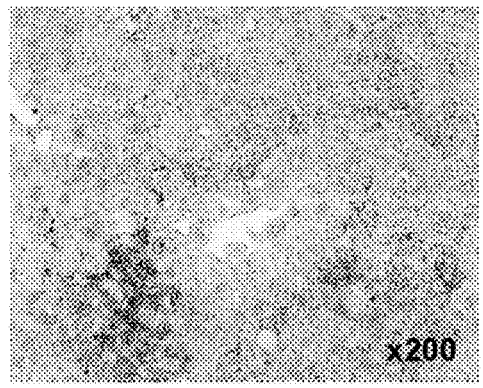
FIG. 59C  FIG. 59D

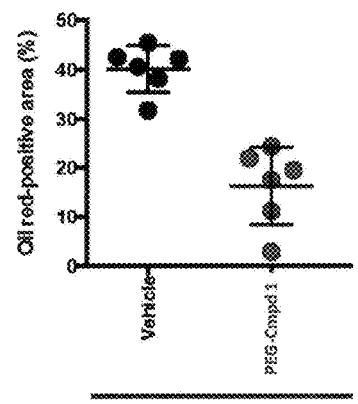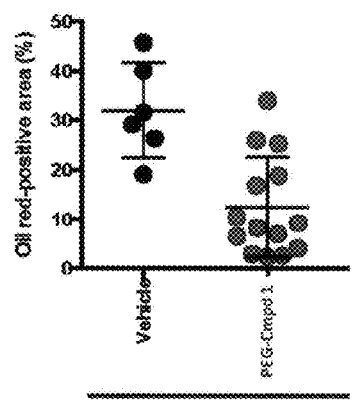
FIG. 60A  p<0.001     FIG. 60B  p<0.001
Treatment Period: 9-12 wks     9-15 wks

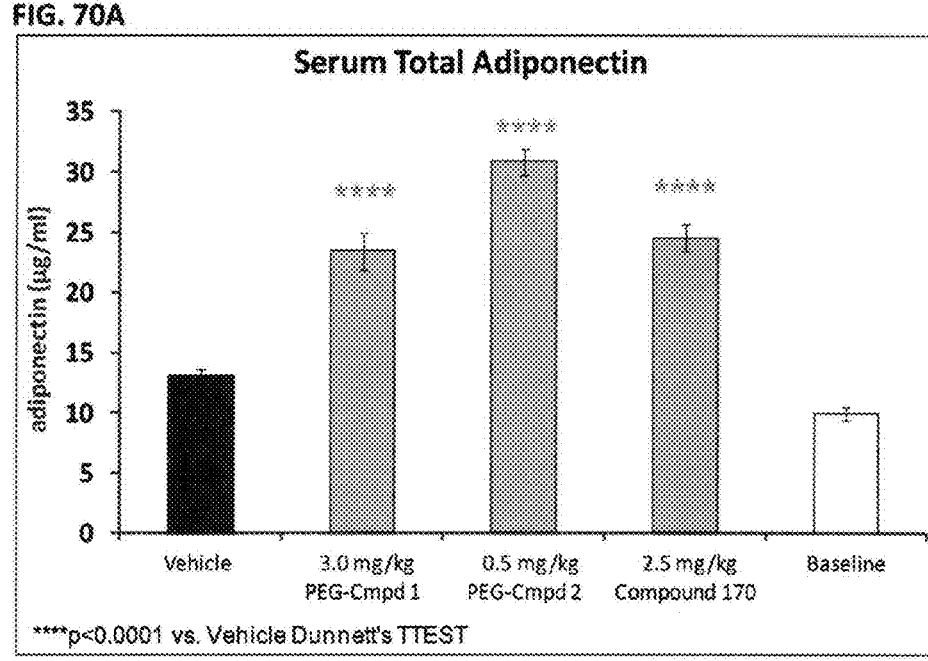
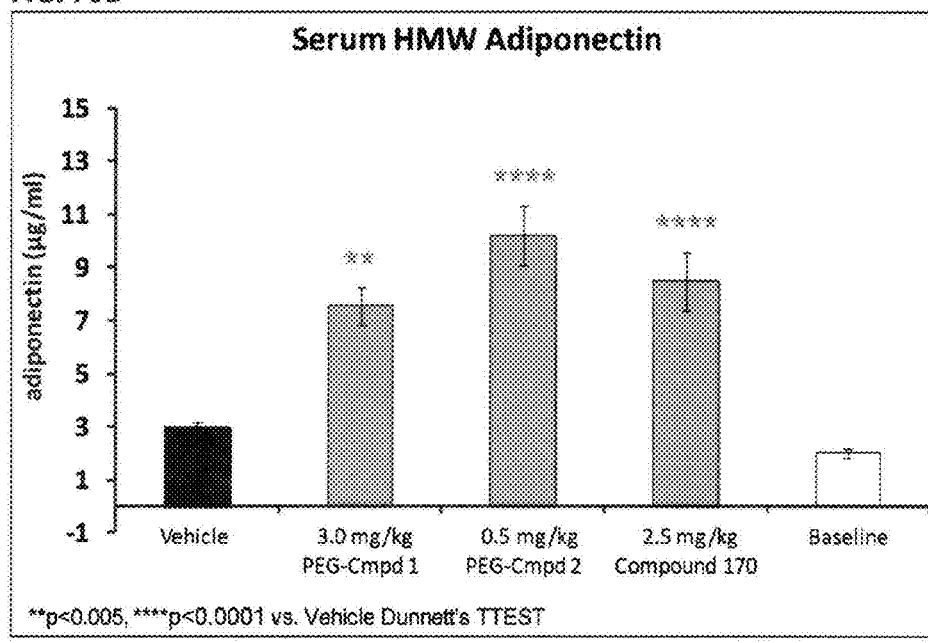

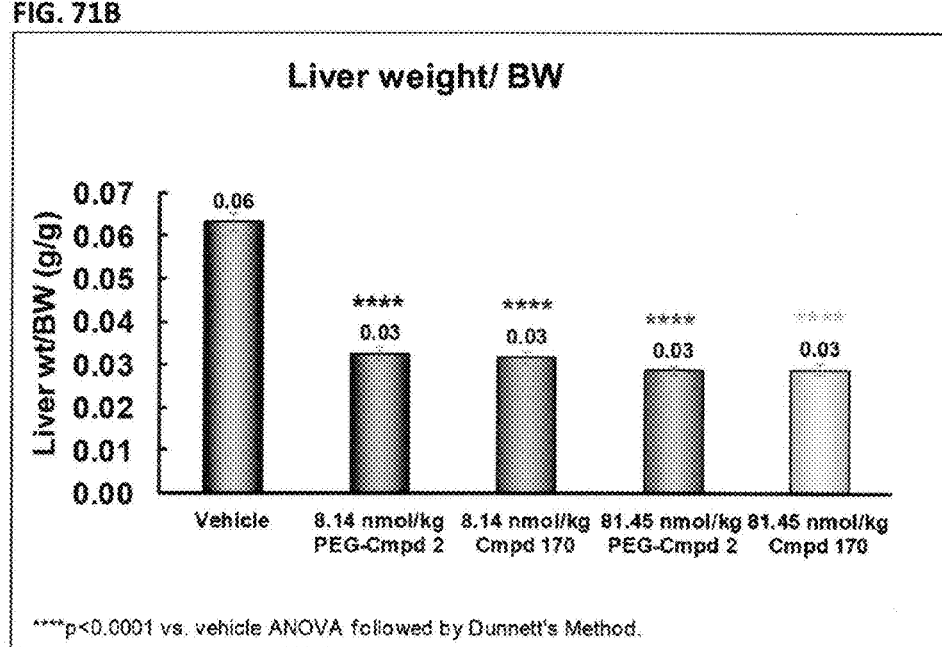

MODIFIED FGF-21 POLYPEPTIDES COMPRISING AN INTERNAL DELETION AND USES THEREOF

RELATED APPLICATION DISCLOSURE

This application claims the benefit of U.S. Provisional Application Ser. No. 62/141,337 filed on Apr. 1, 2015; U.S. Provisional Application Ser. No. 62/141,383 filed on Apr. 1, 2015; U.S. Provisional Application Ser. No. 62/068,296 filed on Oct. 24, 2014; U.S. Provisional Application Ser. No. 62/068,523 filed on Oct. 24, 2014; U.S. Provisional Application Ser. No. 62/068,514 filed on Oct. 24, 2014; U.S. Provisional Application Ser. No. 62/068,534 filed on Oct. 24, 2014; and U.S. Provisional Application Ser. No. 62/068,526 filed on Oct. 24, 2014; each of which is hereby incorporated by reference in its entirety.

SEQUENCE LISTING DISCLOSURE

This application includes as part of its disclosure a biological sequence listing in a file named "43270o2201v2.txt"and having a size of 610,842bytes, created on May 12, 2016, which is hereby incorporated by reference in its entirety.

FIELD

This disclosure relates to modified FGF-21 polypeptides containing an internal deletion that is optionally replaced by a peptide and the uses thereof for treatment or prevention of diseases and disorders.

BACKGROUND

Fibroblast growth factors are polypeptides widely expressed in developing and adult tissues (Baird et al., Cancer Cells, 3:239-243, 1991) that play crucial roles in multiple physiological functions (McKeehan et al., Prog. Nucleic Acid Res. Mol. Biol. 59:135-176, 1998; Burgess, W. H. et al., Annu. Rev. Biochem. 58:575-606 (1989). According to the literature, the FGF family consists of at least twenty-two members (Reuss et al., Cell Tissue Res. 313: 139-157 (2003)).

Fibroblast growth factor 21 (FGF-21) has been described in the literature (Nishimura et al., Biochimica et Biophysica Acta, 1492:203-206 (2000); WO 01/36640; and WO 01/18172, and U.S. Patent Publication No. 20040259780, each of which is incorporated by reference herein in its entirety). Unlike other FGFs, FGF-21 has been reported not to have proliferative and tumorigenic effects (Ornitz and Itoh, Genome Biology 2001, 2(3):reviews 3005.1-3005.12).

Certain FGF-21 polypeptides and uses thereof are described in U.S. Patent Publication No. 20010012628, U.S. Pat. No. 6,716,626, U.S. Patent Publication No. 2004/0259780, WO 03/011213, Kharitonenkov et al. *J Clin Invest.* 2005 June; 115(6):1627-35, WO 03/059270, U.S. Patent Publication No. 2005/0176631, WO 2005/091944, WO 2007/0293430, U.S. Patent Publication No. 2007/0293430, WO/2008/121563, U.S. Pat. No. 4,904,584, WO 99/67291, WO 99/03887, WO 00/26354, and U.S. Pat. No. 5,218,092 each of which is incorporated by reference herein in its entirety.

Human FGF-21 has been reported to have a propensity to undergo proteolysis in vivo, form aggregates in vitro, undergo deamidation (Gimeno and Moller, Trends Endocrinol Metab. 2014 June; 25(6):303-11; U.S. Pat. No. 8,361, 963; Hecht et al., PLoS One. 2012; 7(11):e49345; U.S. Patent Publication No. 2007/0293430; WO 2006/0065582), potentially limiting the shelf-life of pharmaceutical compositions containing FGF-21. Aggregates and deamidated forms of therapeutic polypeptides may potentially increase immunogenicity (see U.S. Department of Health and Human Services, "Immunogenicity Assessment for Therapeutic Protein Products," August 2014; Subramanyam (ed.), "Therapeutic Protein Immunogenicity Focus Group Newsletter," American Association of Pharmaceutical Scientists, Vol. 1, Issue 3 (December 2011)).

Prior work published as WO 2008/121563 and U.S. Patent Publication No. 2008/0255045 demonstrated that certain human FGF-21 polypeptides modified to contain a non-naturally encoded amino acid linked to poly(ethylene glycol) at specified positions exhibited increased in vivo half-life and/or retained biological activity. The exemplified human FGF-21 polypeptides did not, however, include sequence deletions or substitutions described herein.

Fibrosis is the formation of excess fibrous connective tissue in an organ or tissue. Excess deposition of fibrous tissue is associated with pathological conditions that can lead to impairment of organ or tissue function. Affected organs can include the lungs (lung or pulmonary fibrosis), liver (liver or hepatic fibrosis), kidney (kidney or renal fibrosis), and heart (cardiac fibrosis). Fibrosis can also affect other tissues and organs including joints, skin, intestine, bone marrow, and others. Exemplary fibrotic conditions or diseases include, but are not limited to, nonalcoholic steatohepatitis (NASH), which affects the liver; diabetic kidney disease and diabetic nephropathy, which affect the kidney; and metabolic heart failure, which affects the heart. For example, NASH is characterized by fat, inflammation and damage in the liver in people who consume little or no alcohol and can lead to liver cirrhosis. NASH tends to be diagnosed in overweight or obese middle-aged people who often have elevated blood lipid levels and diabetes or prediabetes.

Embodiments of the present invention address, among other things, problems associated with the activity and production of FGF-21 polypeptides, the production of an FGF-21 polypeptide with improved biological or pharmacological properties, such as improved therapeutic half-life, and methods of treating or preventing diseases and disorders.

SUMMARY

Provided herein are modified FGF-21 polypeptides comprising a polypeptide having an amino acid sequence selected from SEQ ID NOs: 1-7, except that said amino acid sequence comprises: (i) an internal deletion of between 2 and 19 amino acids (such as between 5 and 19 amino acids), wherein said internal deletion is within a region corresponding to amino acids 116 to 134 of SEQ ID NO:1, wherein said internal deletion is replaced by a replacement peptide having a length of between 0-12 amino acids; and (ii) 9 or fewer additional amino acid substitutions, deletions, and/or insertions.

Also provided herein are compositions comprising any of the modified FGF-21 polypeptides described herein and a pharmaceutically acceptable carrier or excipient.

Provided herein are modified FGF-21 polypeptides comprising a polypeptide having an amino acid sequence selected from SEQ ID NOs: 1-7, except that said amino acid sequence comprises: (i) an internal deletion of between 2 and 19 amino acids (such as between 5 and 19 amino acids), wherein said internal deletion is within a region corresponding to amino acids 116 to 134 of SEQ ID NO:1, wherein said internal deletion is replaced by a replacement peptide having a length of between 0-12 amino acids; and (ii) 9 or fewer additional amino acid substitutions, deletions, and/or insertions; and (iii) a fusion partner.

Also provided herein are methods of regulating at least one of glucose and lipid homeostasis, glucose uptake, GLUT 1 expression, and/or serum concentrations of glucose, triglycerides, insulin or glucagon in a patient in need thereof, comprising administering to the patient a therapeutically effective amount of a modified FGF-21 polypeptide described herein.

Also provided herein are methods of increasing insulin sensitivity, increasing the level of adiponectin, reducing the level of blood glucose, reducing the level of glucagon, reducing the level of triglyceride, reducing the level of fructosamine, reducing the level of low density cholesterol, or reducing the level of C-reactive protein in a patient in need thereof or in a sample of blood, serum, or another sample of said patient, comprising administering to the patient a therapeutically effective amount of a modified FGF-21 polypeptide described herein.

Also provided herein are methods of treating a condition or disorder selected from obesity, diabetes, pancreatitis, insulin resistance, hyperinsulinemia, glucose intolerance, hyperglycemia, metabolic syndrome, impaired glucose tolerance, inadequate glucose clearance, high blood glucose, Type A Insulin Resistance, Type C Insulin Resistance (AKA HAIR-AN Syndrome), Rabson-Mendenhall Syndrome, Donohue's Syndrome or Leprechaunism, hyperandrogenism, hirsuitism, or acanthosis nigracans, and Prader-Willi syndrome in a patient in need thereof, comprising administering to the patient a therapeutically effective amount of a modified FGF-21 polypeptide described herein.

Also provided herein are methods of treating type 1 diabetes, type 2 diabetes or obesity in a patient in need thereof, comprising administering to the patient a therapeutically effective amount of a modified FGF-21 polypeptide described herein.

Also provided herein are methods of treating a disease associated with fibrosis comprising administering to a patient in need thereof an effective amount of a modified FGF-21 polypeptide described herein.

Also provided herein are methods of treating a disease associated with fibrosis comprising administering to a patient in need thereof an effective amount of a composition comprising the modified FGF-21 polypeptide described herein and a pharmaceutically acceptable carrier or excipient.

Also provided herein are methods of treating liver fibrosis or cirrhosis in a patient in need thereof, comprising administering to the patient a therapeutically effective amount of a modified FGF-21 polypeptide described herein.

Also provided herein are methods of treating or preventing NASH in a patient in need thereof, comprising administering to the patient a therapeutically effective amount of a modified FGF-21 polypeptide described herein.

Also provided herein are methods of treating NASH and/or liver fibrosis, comprising administering to a patient in need thereof an effective amount of a composition comprising the modified FGF-21 polypeptide described herein and a pharmaceutically acceptable carrier or excipient.

Also provided herein are methods of decreasing the hepatic fat fraction in a patient in need thereof, comprising administering to the patient a therapeutically effective amount of a modified FGF-21 polypeptide described herein, wherein optionally said patient is at risk of developing or has been diagnosed with NASH.

Also provided herein are methods of increasing adiponectin levels (such as plasma total adiponectin and/or high molecular weight adiponectin) in a patient in need thereof, comprising administering to the patient a therapeutically effective amount of a modified FGF-21 polypeptide described herein, wherein optionally said patient is at risk of developing or has been diagnosed with NASH.

Also provided herein are methods of treating heart failure or cardiac fibrosis in a patient in need thereof comprising administering to the patient a therapeutically effective amount of a modified FGF-21 polypeptide described herein.

Also provided herein are methods of treating kidney or renal fibrosis in a patient in need thereof comprising administering to the patient a therapeutically effective amount of a modified FGF-21 polypeptide described herein.

Also provided herein are methods of treating lung fibrosis in a patient in need thereof comprising administering to the patient a therapeutically effective amount of a modified FGF-21 polypeptide described herein.

Also provided herein are methods of treating a disease associated with fibrosis in a patient in need thereof, comprising administering to the patient an effective amount of a modified FGF-21 polypeptide comprising one or more non-naturally encoded amino acids, wherein said modified FGF-21 polypeptide possesses at least 90% identity to a human FGF-21 polypeptide having an amino acid sequence selected from SEQ ID NOs:1-7 and 201, wherein said disease associated with fibrosis is selected from NASH, liver fibrosis, diabetic kidney disease, chronic kidney disease, renal fibrosis, lung fibrosis, cardiac fibrosis, heart failure, and metabolic heart failure.

BRIEF DESCRIPTION OF THE SEVERAL VIEWS OF THE DRAWINGS

FIG. 1A-B. Exemplary modified FGF-21 polypeptide sequences. Coordinates indicated are relative to the wild-type FGF-21 polypeptide of SEQ ID NO:1. The full polypeptides each include the N-terminal sequence MEIPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVY (SEQ ID NO:488), followed by the indicated amino acid at position 108, followed by the indicated sequence of the region labeled "Amino Acids 109-149", followed by the sequence PGILAPQPPDVGSSDPLSM (SEQ ID NO:489), followed by the indicated sequence of the region labeled "Amino Acids 169-181." The full amino acid sequences of the modified FGF-21 polypeptides are also shown in Example 4, below. The polypeptide sequences shown in FIG. 1A in the fourth column correspond to SEQ ID NOs: 491-513, respectively, and those in the fifth column correspond to SEQ ID NOs: 514-536, respectively. The polypeptide sequences shown in FIG. 1B in the fourth column correspond to SEQ ID NOs: 537-557, respectively, and those in the fifth column correspond to SEQ ID NOs: 558-578, respectively.

FIG. 11A-B. Pharmacokinetic analysis of Pegylated Compound 1 and Pegylated Compound 2 after administration to cynomolgus monkeys. Levels of the modified FGF-21 compounds were measured as both the (A) total and (B) C-terminally intact (active) polypeptides. Pegylated Compound 2 exhibited a much greater total AUC for the C-terminally intact form than Pegylated Compound 1, indicating greatly reduced in vivo proteolysis of Pegylated Compound 2.

FIG. 19. Body weight changes in a Stelic NASH mouse study.

FIG. 20. Total food consumption in a Stelic NASH mouse study.

FIG. 21. Body weight in a Stelic NASH mouse study.

FIG. 22. Liver weight in a Stelic NASH mouse study.

FIG. 23. Liver-to-body weight ratio in a Stelic NASH mouse study.

FIG. 24. Whole blood glucose in a Stelic NASH mouse study.

FIG. 25. Plasma ALT in a Stelic NASH mouse study.

FIG. 26. Plasma triglyceride in a Stelic NASH mouse study.

FIG. 27. Plasma total cholesterol in a Stelic NASH mouse study.

FIG. 28. Liver triglyceride in a Stelic NASH mouse study.

FIG. 29. Liver cholesterol in a Stelic NASH mouse study.

FIG. 30A-B. Representative photomicrographs of HE-stained liver sections in a Stelic NASH mouse study.

FIG. 31. NAFLD Activity score in a Stelic NASH mouse study.

FIG. 32A. Steatosis score in a Stelic NASH mouse study.

FIG. 32B. Lobular inflammation score in a Stelic NASH mouse study.

FIG. 32C. Hepatocyte ballooning score in a Stelic NASH mouse study.

FIG. 33A-B. Representative photomicrographs of Sirius red-stained liver sections in a Stelic NASH mouse study.

FIG. 34. Fibrosis area in a Stelic NASH mouse study.

FIG. 35A-B. Representative photomicrographs of F4/80-immunostained liver sections in a Stelic NASH mouse study.

FIG. 36 Inflammation area in a Stelic NASH mouse study.

FIG. 37A-B. Representative photomicrographs of Oil red-stained liver sections in a Stelic NASH mouse study.

FIG. 38. Fat deposition area in a Stelic NASH mouse study.

FIG. 40A-D. Exemplary modified FGF-21 polypeptide sequences fused to an Fc domain, a PKE adnectin or human serum albumin polypeptide. "Fusion Arrangement" describes the general orientation of the fusion protein, from the N- to C-terminus, which is intended to illustrate, but not to limit, the corresponding polypeptide sequence. HuSA (C34A): a modified human serum albumin having the amino acid sequence of SEQ ID NO:321); HuSA(C34A; des Leu-585): a modified human serum albumin having the amino acid sequence of SEQ ID NO:322; PKE(1): a PKE adnectin having the amino acid sequence of SEQ ID NO:319; PKE (2): a PKE adnectin having the amino acid sequence of SEQ ID NO:320. L followed by a number indicates a linker; FGF-21(Cmp. 2) indicates an FGF-21 sequence containing an internal deletion and replacement peptide (specifically, Compound 2) and FGF-21(Cmp. 1) indicates an FGF-21 sequence lacking said deletion and replacement peptide (specifically, Compound 1). FGF-21(Cmp. 1) and FGF-21 (Cmp. 2) may include or lack the N-terminal methionine contained in Compounds 1 and 2. Variant forms of Fc polypeptide sequences are identified parenthetically, e.g., Fc(hIgG1a_191). The notations FGF-21-1aa(Cmp. 2) and FGF-21-3aa(Cmp. 2) refer to the Compound 2 sequence modified by deletion of the recited number of amino acids (1 or 3, respectively) from its C-terminus.

FIG. 42A-B. Body weight of treatment groups in a Stelic NASH mouse study. A. Comparison of mice treated with vehicle or PEG-Compound ("PEG-Cmpd") 1 for weeks 9-12. B. Comparison of mice treated with vehicle or PEG-Compound 1 for weeks 9-15.

FIG. 43A-B. Liver weight of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Liver weight was significantly decreased ($p<0.001$) for mice treated over weeks 9-15.

FIG. 44A-B. Liver-to-body weight ratio of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Liver-to-body weight ratio was significantly decreased ($p<0.01$ and $p<0.001$, respectively) for mice treated over weeks 9-12 or weeks 9-15.

FIG. 45A-B. Right kidney weight of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15.

FIG. 47A-B. Whole blood glucose of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Whole blood glucose was significantly decreased ($p<0.05$) for mice treated over weeks 9-15.

FIG. 48A-B. Plasma ALT of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Plasma ALT was significantly decreased ($p<0.01$) for mice treated over weeks 9-15.

FIG. 51A-B. Liver triglyceride of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Liver triglycerides were significantly decreased ($p<0.01$ and $p<0.001$, respectively) for mice treated over weeks 9-12 or weeks 9-15.

FIG. 52A-B. Liver cholesterol of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Liver cholesterol was significantly decreased ($p<0.01$ and $p<0.001$, respectively) for mice treated over weeks 9-12 or weeks 9-15.

FIG. 54A-B. NAFLD activity score of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. NAFLD activity score was significantly decreased ($p<0.01$ and $p<0.001$, respectively) for mice treated over weeks 9-12 or weeks 9-15.

FIG. 55A-H. Representative photomicrographs of Sirius red-stained liver sections of mice treated for weeks 9-12 with vehicle (A-B) or PEG-Compound 1 (C-D), and for weeks 9-15 with vehicle (E-F) or PEG-Compound 1 (G-H).

FIG. 56A-B. Summary of liver fibrosis area of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Fibrosis area was significantly decreased ($p<0.05$) for mice treated with PEG-Compound 1 for weeks 9-15.

FIG. 57A-H. Representative photomicrographs of F4/80-immunostained liver of mice treated for weeks 9-12 with vehicle (A-B) or PEG-Compound 1 (C-D), and for weeks 9-15 with vehicle (E-F) or PEG-Compound 1 (G-H).

FIG. 59A-H. Representative photomicrographs of Oil red-stained liver sections of mice treated for weeks 9-12 with vehicle (A-B) or PEG-Compound 1 (C-D), and for weeks 9-15 with vehicle (E-F) or PEG-Compound 1 (G-H).

FIG. 60A-B. Summary of fat deposition area of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15. Fat deposition area was significantly decreased for mice treated over weeks 9-12 or weeks 9-15 (both p<0.001).

FIG. 70A-C. Effects of FGF-21 variants on serum total adiponectin (FIG. 70A), serum high molecular weight (HMW) adiponectin (FIG. 70B), and the ratio of HMW adiponectin to total adiponectin (FIG. 70C) in a Stelic NASH mouse study. All values are mean±SEM.

FIG. 71A-B. Liver weight (FIG. 71A) and liver weight to body weight (BW) ratio (FIG. 71B) in a NASH animal model.

DETAILED DESCRIPTION

Definitions

Figure 2:
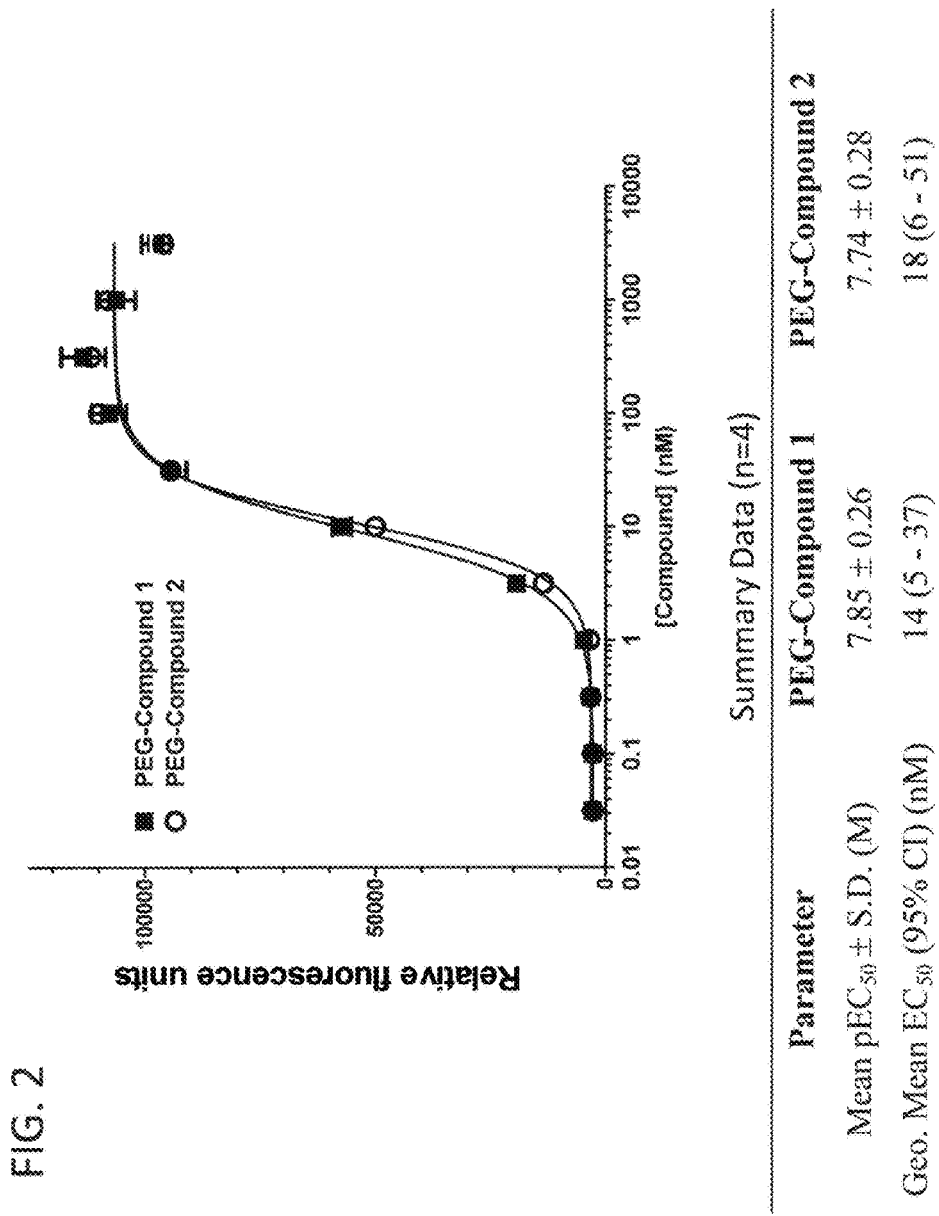
FIG. 2. Exemplary dose response curve for in vitro FGF-21 activity (measured by FGF21-dependent phosphorylation of extracellular signal-regulated kinase (ERK) 1/2 in a cell-based assay) for Pegylated Compound 1 and Pegylated Compound 2.

As used herein and in the appended claims, the singular forms "a," "an," and "the" include plural reference unless the context clearly indicates otherwise. Thus, for example, reference to a "FGF-21," "FGF-21 polypeptide," or "modified FGF-21 polypeptide" is a reference to one or more such proteins and includes equivalents thereof known to those of ordinary skill in the art, and so forth.

Unless defined otherwise, all technical and scientific terms used herein have the same meaning as commonly understood to one of ordinary skill in the art to which this invention belongs.

Normoglycemia: In the present disclosure, the terms normoglycemia or euglycemia refer to the state of having a normal blood glucose concentration. An exemplary normal blood glucose concentration in humans is between 70 mg/dl and 99 mg/dl in fasting adults, and between 70 mg/dl and 140 mg/dl in postprandial adults. Sustained normoglycemia refers to maintenance of normoglycemia for an extensive period of time, e.g., at least one day, at least two days, at least one week, at least two weeks, at least one month, or longer, for example during ongoing treatment with a modified FGF-21 polypeptide of the present disclosure.

The term "half-life extending moiety" (also referred to herein as "HLEM") refers to a pharmaceutically acceptable moiety, domain, or molecule covalently linked ("conjugated" or "fused") to the modified FGF-21 polypeptide described herein, optionally via a non-naturally encoded amino acid, directly or via a linker, that prevents or mitigates in vivo proteolytic degradation or other activity-diminishing chemical modification of the modified FGF-21 polypeptide, increases half-life, and/or improves or alters other pharmacokinetic or biophysical properties including but not limited to increasing the rate of absorption, reducing toxicity, improving solubility, reducing protein aggregation, increasing biological activity and/or target selectivity of the modified FGF-21 polypeptide, increasing manufacturability, and/or reducing immunogenicity of the modified FGF-21 polypeptide, compared to a comparator such as an unconjugated form of the modified FGF-21 polypeptide or wild-type FGF-21 polypeptide. The term "half-life extending moiety" includes non-proteinaceous, half-life extending moieties, such as a water soluble polymer such as polyethylene glycol (PEG) or discrete PEG, hydroxyethyl starch (HES), a lipid, a branched or unbranched acyl group, a branched or unbranched C8-C30 acyl group, a branched or unbranched alkyl group, and a branched or unbranched C8-C30 alkyl group; and proteinaceous half-life extending moieties, such as serum albumin, transferrin, adnectins (e.g., albumin-binding or pharmacokinetics extending (PKE) adnectins), Fc domain, and unstructured polypeptide, such as XTEN and PAS polypeptide (e.g. conformationally disordered polypeptide sequences composed of the amino acids Pro, Ala, and/or Ser), and a fragment of any of the foregoing. An examination of the crystal structure of FGF-21 or FGF family member(s) and its interaction with the FGF receptor can indicate which certain amino acid residues have side chains that are fully or partially accessible to solvent. The side chain of a non-naturally encoded amino acid at these positions may point away from the protein surface and out into the solvent and thus be linked to, e.g., a water soluble polymer.

The term "albumin binding moiety" as used herein refers to any chemical group capable of binding to albumin, i.e. has albumin binding affinity, for example, albumin-binding or PKE adnectin.

"Albumin binding affinity" may be determined by several methods known within the art. In one method the compound to be measured is radiolabeled with e.g. 125I or 3H and incubated with immobilized albumin (Kurtzhals et. al., Biochem. J., 312, 725-731 (1995)). The binding of the compound relative to a standard is calculated. In another method a related compound is radiolabeled and its binding to albumin immobilized on e.g. SPA beads (scintillation proximity assay beads, PerkinElmer cat no. RPNQ0001) is competed by a dilution series of the compound to be measured. The EC50 value for the competition is a measure of the affinity of the compound. In a third method, the receptor affinity or potency of a compound is measured at different concentrations of albumin, and the shift in relative affinity or potency of the compound as a function of albumin concentration reflects its affinity for albumin.

The term "thermal stability" refers to the ability of a polypeptide to resist unfolding when heated. Generally the higher the thermal stability of a molecule, the greater the temperature that is required for the polypeptide to become unfolded. Exemplary methods of determining the thermal stability of a polypeptide are the differential scanning calorimetry (DSC) and thermal scanning fluorescence methods described in Example 6 herein. Thermal stability may be determined with respect to a comparator compound, e.g., to identify a polypeptide having increased thermal stability.

The term "aggregation" refers to the tendency of a polypeptide to form non-covalently linked complexes with other molecules (such as other molecules of the same polypeptide) thereby forming high molecular weight complexes. Exemplary methods of measuring the formation of aggregates include analytical size exclusion chromatography as described in Example 7 herein. Relative amounts of aggregation may be determined with respect to a comparator compound, e.g., to identify a polypeptide having reduced aggregation.

The term "deamidation" refers to the tendency of amino acid residues within a polypeptide to spontaneously undergo a deamidation reaction, thereby changing the chemical structure of the amino acid, and potentially affecting the function of the polypeptide. Exemplary methods of measuring deamidation include imaged capillary isoelectric focusing (icIEF) as described in Example 7 herein. The relative amount of deamidation may be determined with respect to a comparator compound, e.g., to identify a polypeptide having decreased deamidation.

The term "in vivo proteolysis" refers to the cleavage of a polypeptide when introduced into a living system (e.g., when injected into an organism) which may result from proteases occurring in said organism. Proteolysis can potentially affect the biological activity or half-life of a polypeptide. For example, wild-type FGF-21 can undergo cleavage at the C-terminus, resulting in a truncated, inactive polypeptide. An exemplary method of measuring in vivo proteolysis of FGF-21 is the Meso Scale Discovery (MSD)-based electrochemiluminescent immunosorbent assay (ECLIA) described in Example 10 herein. The relative amount of in vivo proteolysis may be determined with respect to a comparator compound, e.g., to identify a polypeptide having decreased in vivo proteolysis.

The term "solubility" refers to the amount of a substance that can dissolve in another substance, e.g., the amount of an unmodified or modified FGF-21 polypeptide that can dissolve in an aqueous solution. An exemplary method of measuring the solubility of an unmodified or modified FGF-21 polypeptide is the plug flow solubility test described in Example 8 herein. Relative solubility may be determined with respect to a comparator compound, e.g., to identify a polypeptide having increased solubility.

The term "biological activity" refers to the ability of a molecule to affect any physical or biochemical properties of a biological system, pathway, molecule, or interaction relating to an organism, including but not limited to, viruses, bacteria, bacteriophage, transposon, prion, insects, fungi, plants, animals, and humans. For example, in the context of an unmodified or modified FGF-21, biological activity includes any of the functions performed by FGF-21 as described herein. Exemplary methods of determining whether a molecule possesses at least one biological activity of wild-type FGF-21 (such as the wild-type FGF-21 polypeptide of SEQ ID NO: 1) may include the in vitro assay described in Example 5 or the in vitro assay described in Example 17. The relative level of biological activity may be determined with respect to a comparator compound, e.g., to identify a polypeptide having biological activity or having sufficiently high biological activity for an intended therapeutic use, e.g., having an EC50 less than 5-fold, 10-fold, less than 20-fold, less than 50-fold, or less than 100-fold higher than the EC50 of a comparator.

The comparator compound described herein may be another sequence lacking a modification, such as a modification described herein. For example, the comparator compound may be the same modified FGF-21 polypeptide sequence without an internal deletion, without a replacement peptide, or without a fusion partner. Exemplary comparator compounds include without limitation the wild-type FGF-21 polypeptide of SEQ ID NO:1, a modified FGF-21 polypeptide of SEQ ID NO:201, or another comparator compound. In some embodiments, the comparator compound may contain at least one non-naturally encoded amino acid, which may be linked to a linker, polymer, biologically active molecule, peptide, polypeptide, or half-life extending moiety described herein (e.g. PEG). In some embodiments, a comparator compound may contain at least one non-naturally encoded amino acid, which may not be linked to a linker, polymer, biologically active molecule, peptide, polypeptide, or half-life extending moiety described herein (e.g. PEG). In some embodiments, a comparator compound may contain additional amino acid substitutions, deletions, and/or insertions. In some embodiments, the comparison may be performed with a pegylated or non-pegylated form of the polypeptide; in the former instance, the comparison may be performed with a polypeptide comprising or not comprising a non-naturally encoded amino acid. In some embodiments, a comparator compound may contain an internal deletion that is optionally replaced by a peptide (e.g., the same internal deletion and replacement peptide in the compound to which the comparator is being compared), but without a fusion partner.

The term "Fc," "Fc domain," or "Fc region" refers to an Fc domain or fragment thereof. An Fc may be a native Fc region comprising an amino acid sequence identical to the amino acid sequence of an Fc region found in nature, or a variant Fc region comprising an amino acid sequence which differs from that of a native Fc region by virtue of at least one amino acid. In some embodiments, the Fc has at least one amino acid substitution compared to a native Fc region or to the Fc region of a parent polypeptide, e.g., from about one to about twenty, from about one to about ten, or from about one to about five amino acid substitutions, deletions or insertions in a native Fc region or in the Fc region of the parent polypeptide. The Fc region herein may possess at least about 80%, 85%, 90%, 95%, 96%, 97%, 98%, or 99% sequence identity with a native Fc region and/or with an Fc region of a parent polypeptide. In some embodiments, the Fc region may have at least about 90% sequence identity with a native Fc region and/or with an Fc region of a parent polypeptide. In some embodiments, the Fc region may have at least about 95% sequence identity with a native Fc region and/or with an Fc region of a parent polypeptide. Exemplary amino acid sequences of Fc regions include SEQ ID NOs: 302 and 323-335. Exemplary domains or fragments of Fc regions include the polypeptides of SEQ ID NOs:303-309.

As used herein, a "functional Fc region" refers to an Fc domain or fragment thereof which retains the ability to bind FcRn.

The term "corresponding" refers to a position ("position corresponding" or "corresponding position") or region ("region corresponding" or "corresponding region") within a polypeptide or polynucleotide sequence that is identified by comparison to a reference sequence. The reference sequence may be a wild-type or unmodified sequence, such as the wild-type FGF-21 polypeptide of SEQ ID NO:1. A corresponding position or region may be identified by alignment of the sequence with a reference sequence. For example, the "position corresponding to amino acid 108 in SEQ ID NO:1" in a sequence refers to the position in the sequence that is in the same alignment column as amino acid 108 in SEQ ID NO:1 when that sequence is aligned with SEQ ID NO:1. In the alignment, the amino acid or nucleotide may or may not match the amino acid or nucleotide in the corresponding position in the reference sequence. When referring to a deletion of a corresponding region, the alignment may contain gaps in the alignment columns corresponding to each position within the deleted region, unless the deleted region has been replaced by a replacement peptide which may potentially align with part of the deleted region. Thus, for a deletion replaced by a replacement peptide, the replacement peptide may be omitted from the sequence when performing the alignment, such that the alignment should contain gaps throughout the deleted region. Alternatively, the replacement peptide, if present, may be disregarded when identifying a corresponding region.

The alignment used to identify a corresponding position or corresponding region may be obtained using a conventional alignment algorithm such as Blast (Altschul et al., J Mol Biol. 1990 Oct. 5; 215(3):403-10), Smith-Waterman (Smith and Waterman, J Mol Biol. 1981 Mar. 25; 147(1): 195-7), or Needleman-Wunsch (Needleman and Wunsch, J Mol Biol. 1970 March; 48(3):443-53). The Needleman-Wunsch algorithm may be used in order to obtain the highest-scoring global alignment (i.e., an alignment containing every residue in both sequences, though an alignment may start and/or end in gaps). Whether Blast, Smith-Waterman, or Needleman-Wunsch is utilized, the highest scoring alignment may be identified using "default" parameters, such as use of the BLOSUM62 scoring matrix, a gap open penalty of 11, and a gap extend penalty of 1, and (when using Blast for pairwise alignment) a word size of 3.

"Region" refers to a contiguous portion of a polypeptide or polynucleotide sequence. A region may be identified by two positions within a polypeptide or polynucleotide that specify the start and end positions of the region within the sequence. Unless specified otherwise, a region is inclusive of the positions defining the region within the reference sequence, i.e., includes the given start and end positions. For example, the region 119-130 of SEQ ID NO:1 refers to the portion of SEQ ID NO:1 starting at amino acid 119 and ending at amino acid 130, including amino acids 119 and 130, which has the sequence PGNKSPHRDPAP (SEQ ID NO:73).

The term "deletion" refers to the removal of one or more (or a specified number of) contiguous amino acids or nucleotides from a polypeptide or polynucleotide. An "internal deletion" refers to a deletion that does not include the N- or C-terminus of a polypeptide or the 5' or 3' end of a polynucleotide. A deletion or an internal deletion can be identified by specifying the start and end positions of the deletion relative to a reference sequence. With respect to a modified FGF-21 polypeptide, a reference to an internal deletion generally specifies the deletion of a region relative to a reference FGF-21 polypeptide, such as a deletion of a region corresponding to positions of the wild-type FGF-21 polypeptide of SEQ ID NO:1, for example, amino acid positions 119-130 in SEQ ID NO:1 (i.e., PGNKSPHRDPAP (SEQ ID NO:73)).

"Replacement peptide" refers to amino acids that are inserted in place of an internal deletion or other deletion within a polypeptide. The length of the replacement peptide may differ from the length of the internal deletion. Exemplary replacement peptides may comprise one or more glycine, serine, and histidine residues, and in some instances, additional amino acid residues such as lysine and proline. However, it is to be understood that a replacement peptide is not limited to sequences containing these particular amino acids, but rather may include any natural amino acid or non-naturally encoded amino acid. A replacement peptide may be of any length, e.g., a single amino acid (i.e., having a length of 1 amino acid), two or more amino acids, or three or more amino acids. A replacement peptide having a length of zero amino acids indicates that a replacement peptide is not present. In some embodiments, the replacement polypeptide may have a length of 1, 2, 3, 4, 5, 6, 7, 8, 9, 10, 11 or 12 amino acids. In some embodiments, the replacement polypeptide may have a length of 1-10, 1-7, 1-5, or 1-3 amino acids. In some embodiments, the replacement polypeptide may have a length of 2-7, 2-5 or 2-3 amino acids. In some embodiments, the replacement polypeptide may have a length of 3 amino acids. Exemplary replacement peptides include the sequences G, GG, SG, GSG, GGH, SGG, GSGH (SEQ ID NO:343), HSG, HHSG (SEQ ID NO:344), HGSH (SEQ ID NO:345), GSGP (SEQ ID NO:346), HGG, HSGG (SEQ ID NO:347), and HGSG (SEQ ID NO:348). Additional exemplary replacement peptides include the sequences K, DKS, HKS, D, Q, KDS, and KDSQ (SEQ ID NO:349).

"Fusion partner" refers to a peptide or polypeptide fused to the modified FGF-21 polypeptide described herein. The fusion partner may be fused to the modified FGF-21 polypeptide on the N- and/or C-terminus. Exemplary fusion partners include, but are not limited to, albumin, transferrin, adnectins (e.g., albumin-binding or pharmacokinetics extending (PKE) adnectins), Fc domain, and unstructured polypeptide, such as XTEN and PAS polypeptide (e.g. conformationally disordered polypeptide sequences composed of the amino acids Pro, Ala, and/or Ser), or a fragment of any of the foregoing. The fusion partner may be fused to the modified FGF-21 polypeptide for any purpose, including but not limited to, purification, manufacturability, half-life extension, enhanced biophysical properties (e.g. solubility or stability), reduced immunogenicity or toxicity, etc.

"Connecting peptide" refers to an amino acid sequence having both its N- and C-termini fused to other peptides or polypeptides. A connecting peptide may be present in a fusion protein, e.g., having its termini fused (in either order) to a modified FGF-21 polypeptide and a fusion partner. Exemplary connecting peptides may comprise between 0 amino acids (i.e., no connecting peptide present) and 1, 2, 3, 4, 5, 6, 7, 8, 9, 10, 11, 12, 13, 14, 15, 16, 17, 18, 19, 20, 25, 30, 35, 40, 45, 50, 60, or 100 amino acids, or more. In some embodiments, the connecting peptide may comprise between 1 and 40, between 1 and 30, between 1 and 20, between 1 and 10, between 1 and 5, between 2 and 40, between 2 and 30, between 2 and 20, between 2 and 10, between 5 and 40, between 5 and 30, between 5 and 20, or between 5 and 10 amino acids. In some embodiments, the connecting peptide may comprise between 5 and 20 amino acids. In some embodiments, the connecting peptide may comprise between 10 and 20 amino acids. Certain exemplary connecting peptides described herein may be rich in serine and glycine residues, however, it is to be understood that the connecting peptide is not limited to such sequences. Exemplary connecting peptides include the following sequences: GAGGGGSG (SEQ ID NO:74), EPKSSD (SEQ ID NO:75), D, ESPKAQASSVPTAQPQAEGLA (SEQ ID NO:76), ELQLEESAAEAQDGELD (SEQ ID NO:77), GQPDEPGGS (SEQ ID NO:78), GGSGSGSGSGSGS (SEQ ID NO:79), ELQLEESAAEAQEGELE (SEQ ID NO:80), GSGSG (SEQ ID NO:81), GSGC (SEQ ID NO:82), AGGGGSG (SEQ ID NO:83), GSGS (SEQ ID NO:84), QPDEPGGS (SEQ ID NO:85), GSGSGS (SEQ ID NO:86), TVAAPS (SEQ ID NO:87), KAGGGGSG (SEQ ID NO:88), KGSGSGSGSGSGS (SEQ ID NO:89), KQPDEPGGS (SEQ ID NO:90), KELQLEESAAEAQDGELD (SEQ ID NO:91), KTVAAPS (SEQ ID NO:92), KAGGGGSGG (SEQ ID NO:93), KGSGSGSGSGSGSG (SEQ ID NO:94), KQPDEPGGSG (SEQ ID NO:95), KELQLEESAAEAQDGELDG (SEQ ID NO:96), KTVAAPSG AGGGGSGG (SEQ ID NO:97), AGGGGSG (SEQ ID NO:98), GSGSGSGSGSGSG (SEQ ID NO:99), QPDEPGGSG (SEQ ID NO:100), TVAAPSG (SEQ ID NO:301), GGGGSGGGSGGGGSGGGSGGGGSGGGS (SEQ ID NO:350), PSPEPPTPEPPSPEP (SEQ ID NO:351), ELQLEESAAEAQEGELE (SEQ ID NO:352), SSGGGGSGGGSGGGGS (SEQ ID NO:353), GS (SEQ ID NO: 354), GGGGS (SEQ ID NO: 355), EEEEDEEEED (SEQ ID NO: 356), PSPEPPTPEP (SEQ ID NO: 357), GSHHHHHHHGS (SEQ ID NO: 358), GGGGSGGGGSGGGGS (SEQ ID NO: 359), GGGGGSGGGSGGGGS (SEQ ID NO: 360), GSGSGSGSGSGSGSGS (SEQ ID NO: 361), PSTPPTPSPSTPPTPSPS (SEQ ID NO: 362), RGGEEKKKEKEKEEQEERETKTP (SEQ ID NO: 363), GGGGSGGGGSGGGGSGGGGSGGGGS (SEQ ID NO: 364), PSPEPPTPEPPSPEPPTPEPPSPEPPTPEP (SEQ ID NO: 365), PSTPPTPSPSTPPTPSPSPSTPPTPSPSTPPTPSPS (SEQ ID NO: 366), PSPEP (SEQ ID NO: 367), PSPEPPTPEPPSPEPPTPEP (SEQ ID NO: 368), PSPEPPTPEPPSPEPPTPEPPSPEPPTPEPPSPEPPTPEP (SEQ ID NO: 369), PTPEPPSPEPPTPEPPSPEP (SEQ ID NO: 370), PSPEPGGGSPTPEP (SEQ ID NO: 371), PSPEPEEEDPTPEP (SEQ ID NO: 372), PSPEPPTPEPEEEDPSPEPPTPEP (SEQ ID NO: 373), PTPEPPSPEPPTPEPEEEDPSPEPPTPEPPSPEP (SEQ ID NO: 374), PTPEPPSPEPPTPEPGGGSPSPEPPTPEPPSPEP (SEQ ID NO: 375), PSPEPTPEPSPEPPTPEPSPEPTPEP (SEQ ID NO: 376), GETGS (SEQ ID NO: 377), GGGGSGGGS (SEQ ID NO: 378), GETGSSGEGT (SEQ ID NO: 379), GETGSSGEGTGSTGS (SEQ ID NO: 380), GGGGSGGGGSGGGGSGGGGS (SEQ ID NO: 381), GETGSSGEGTGSTGSGAGES (SEQ ID NO: 382), and GETGSSGEGTGSTGSGAGESGTGESGEGGS (SEQ ID NO: 383), i.e., SEQ ID NOs:74-100, 301, and 350-383.

The term "disease associated with fibrosis" includes diseases, disorders, and conditions in which fibrosis has been observed to occur or in which fibrosis is known or thought to be associated with or contribute to disease etiology, progression, or symptoms, or in which fibrosis is known or thought to occur as the disease progresses. The fibrosis may affect an organ or tissue such as the pancreas, lung, heart, kidney, liver, eyes, nervous system, bone marrow, lymph nodes, endomyocardium, or retroperitoneum. Exemplary diseases associated with fibrosis include, but are not limited to nonalcoholic steatohepatitis (NASH), liver fibrosis, precirrhosis, cirrhosis, diffuse parenchymal lung disease, cystic fibrosis, lung or pulmonary fibrosis, progressive massive fibrosis, idiopathic pulmonary fibrosis, injection fibrosis, kidney or renal fibrosis, chronic kidney disease, diabetic kidney disease, focal segmental glomerulosclerosis, membranous nephropathy, IgA nephropathy, myelofibrosis, heart failure, metabolic heart failure, cardiac fibrosis, cataract fibrosis, cataract, ocular scarring, pancreatic fibrosis, skin fibrosis, intestinal fibrosis, intestinal strictures, endomyocardial fibrosis, atrial fibrosis, mediastinal fibrosis, Crohn's disease, retroperitoneal fibrosis, keloid, nephrogenic systemic fibrosis, scleroderma, systemic sclerosis, arthrofibrosis, Peyronie's syndrome, Dupuytren's contracture, diabetic neuropathy, adhesive capsulitis, alcoholic liver disease, hepatosteatosis, viral hepatitis, biliary disease, primary hemochromatosis, drug-related cirrhosis, cryptogenic cirrhosis, Wilson's disease, and, alpha 1-antitrypsin deficiency, interstitial lung disease (ILD), human fibrotic lung disease, macular degeneration, retinal retinopathy, vitreal retinopathy, myocardial fibrosis, Grave's ophthalmopathy, drug induced ergotism, cardiovascular disease, atherosclerosis/restenosis, hypertrophic scars, primary or idiopathic myelofibrosis, and inflammatory bowel disease (including, but not limited to, collagenous colitis). In some embodiments, the disease associated with fibrosis may include liver fibrosis, kidney or renal fibrosis, lung or pulmonary fibrosis and heart or cardiac fibrosis. In some embodiments, the disease associated with fibrosis may be liver fibrosis. In some embodiments, the disease associated with fibrosis may be NASH.

The phrase "medically complicated obesity" (also sometimes referred to as "morbid obesity") generally refers to the condition of a subset of obese individuals who also have health complications related to or caused by obesity. Obesity may be determined by determining body mass index (weight in kilograms divided by the square of the height in meters), with a body mass index of 30 m/kg$^2$ or greater indicating obesity. Exemplary health complications present in medically complicated obesity may include one or more of type 2 diabetes mellitus, hypertension, obstructive sleep apnea, coronary artery disease and other cardiovascular disease (including coronary artery disease, stroke, and congestive heart failure), and dyslipidemia. Additional health complications that may be present include nonalcoholic fatty liver disease (such as steatosis, steatohepatitis, or cirrhosis), respiratory disease, obstructive sleep apnea, obesity-hypoventilation syndrome, asthma, restrictive lung disease, cancers, osteoarthritis, cholelithiasis, gastroesophageal reflux disease, gynecologic abnormalities, infertility, abnormal menses, venous stasis, skin problems, intertrigo, cellulitis, increased risk of complications during surgery or pregnancy, urinary incontinence and idiopathic intracranial hypertension. Medically complicated obesity may also be associated with Prader-Willi Syndrome.

The term "substantially purified" refers to an unmodified or modified FGF-21 polypeptide that may be substantially or essentially free of components that normally accompany or interact with the protein as found in its naturally occurring environment, i.e. a native cell, or host cell in the case of recombinantly produced unmodified or modified FGF-21 polypeptides. Unmodified or modified FGF-21 polypeptide that may be substantially free of cellular material includes preparations of protein having less than about 30%, less than about 25%, less than about 20%, less than about 15%, less than about 10%, less than about 5%, less than about 4%, less than about 3%, less than about 2%, or less than about 1% (by dry weight) of contaminating protein. When the unmodified or modified FGF-21 polypeptide or variant thereof is recombinantly produced by the host cells, the protein may be present at about 30%, about 25%, about 20%, about 15%, about 10%, about 5%, about 4%, about 3%, about 2%, or about 1% or less of the dry weight of the cells. When the unmodified or modified FGF-21 polypeptide or variant thereof is recombinantly produced by the host cells, the protein may be present in the culture medium at about 5 g/L, about 4 g/L, about 3 g/L, about 2 g/L, about 1 g/L, about 750 mg/L, about 500 mg/L, about 250 mg/L, about 100 mg/L, about 50 mg/L, about 10 mg/L, or about 1 mg/L or less of the dry weight of the cells. Thus, "substantially purified" unmodified or modified FGF-21 polypeptide as produced by the methods of the present disclosure may have a purity level of at least about 30%, at least about 35%, at least about 40%, at least about 45%, at least about 50%, at least about 55%, at least about 60%, at least about 65%, at least about 70%, specifically, a purity level of at least about 75%, 80%, 85%, and more specifically, a purity level of at least about 90%, a purity level of at least about 95%, a purity level of at least about 99% or greater as determined by appropriate methods such as SDS/PAGE analysis, RP-HPLC, SEC, and capillary electrophoresis.

A "recombinant host cell" or "host cell" refers to a cell that includes an exogenous polynucleotide, regardless of the method used for insertion, for example, direct uptake, transduction, f-mating, or other methods known in the art to create recombinant host cells. The exogenous polynucleotide may be maintained as a nonintegrated vector, for example, a plasmid, or alternatively, may be integrated into the host genome.

As used herein, the term "medium" or "media" includes any culture medium, solution, solid, semi-solid, or rigid support that may support or contain any host cell, including bacterial host cells, yeast host cells, insect host cells, plant host cells, eukaryotic host cells, mammalian host cells, CHO cells, prokaryotic host cells, *E. coli*, or *Pseudomonas* host cells, and cell contents. Thus, the term may encompass medium in which the host cell has been grown, e.g., medium into which the unmodified or modified FGF-21 polypeptide has been secreted, including medium either before or after a proliferation step. The term also may encompass buffers or reagents that contain host cell lysates, such as in the case where the unmodified or modified FGF-21 polypeptide is produced intracellularly and the host cells are lysed or disrupted to release the unmodified or modified FGF-21 polypeptide.

The term "anti-diabetic agent" shall mean any drug that is useful in treating, preventing, or otherwise reducing the severity of any glucose metabolism disorder, or any complications thereof, including any of the conditions, disease, or complications described herein. Anti-diabetic agents include insulin, thiazolidinediones, sulfonylureas, benzoic acid derivatives, alpha-glucosidase inhibitors, or the like. The inventive antidiabetic compositions may be capable of reducing HbA1c levels by at least a 10% or at least a 50% change from the baseline. Antidiabetic agents include insulin potentiators, such as including but not limited to, small molecule insulin potentiators, Taurine, Alpha Lipoic Acid, an extract of Mulberry, Chromium, Glutamine, Enicostemma littorale Blume, Scoparia dulcis, an extract of Tarragon, Andrographis paniculata, Isomalt, Trehalose or D-Mannose which may further potentiate the secretion or activity of insulin.

As used herein, "modified FGF-21 polypeptide," "modified fibroblast growth factor 21" or "modified FGF-21" and unhyphenated forms thereof are used interchangeably and shall include those polypeptides and proteins that differ from wild-type FGF-21 (e.g., wild-type human FGF-21 of SEQ ID NO:1 and SEQ ID NO:5) and typically have at least one biological activity of a fibroblast growth factor 21, as well as FGF-21 analogs, FGF-21 isoforms, FGF-21 mimetics, FGF-21 fragments, hybrid FGF-21 proteins, fusion proteins, oligomers and multimers, homologues, glycosylation pattern variants, variants, splice variants, and muteins, thereof, regardless of the biological activity of same. The term "modified FGF-21 polypeptide" and "modified FGF-21" encompass FGF-21 polypeptides comprising one or more amino acid substitutions, additions or deletions. For example, modified FGF-21 polypeptides of the present disclosure comprise an internal deletion, including those internal deletions shown in FIG. 1 and others described herein.

The term "modified FGF-21 polypeptide" also encompasses polymorphisms (e.g., naturally occurring FGF-21 sequence variants). For example, the "P-form" of FGF-21 contains a proline (P) at position 174 (position 146 in the mature polypeptide of SEQ ID NO:1), while the "L-form" contains a leucine (L) at position 174 (position 146 in the mature polypeptide of SEQ ID NO:5). Exemplary P-form FGF-21 polypeptide sequences are contained in SEQ ID NOs: 1-4 while exemplary L-form FGF-21 polypeptide sequences are contained in SEQ ID NOs: 5-7.

Substitutions in a wide variety of amino acid positions in naturally-occurring FGF-21 have been described. Substitutions including but not limited to, those that modulate solubility or stability, increase agonist activity, increase in vivo or in vitro half-life, increase protease resistance, convert the polypeptide into an antagonist, reduce immunogenicity or toxicity, facilitate purification or manufacturability, etc. and are encompassed by the term "modified FGF-21 polypeptide" or "modified FGF-21." In some cases, the non-naturally encoded amino acid substitution(s) may be combined with other additions, substitutions or deletions within the modified FGF-21 polypeptide to affect other biological traits of the modified FGF-21 polypeptide relative to another FGF-21 polypeptide (e.g., the wild-type FGF-21 polypeptide of SEQ ID NO:1, the modified FGF-21 polypeptide of SEQ ID NO:201, or another FGF-21 polypeptide such as the same FGF-21 polypeptide without said addition, substitution, or deletion, or another unmodified or modified FGF-21 unmodified or modified polypeptide). In some cases, the other additions, substitutions or deletions may increase the stability (including but not limited to, resistance to proteolytic degradation) of the modified FGF-21 polypeptide or increase affinity of the modified FGF-21 polypeptide for its receptor. In some cases, the other additions, substitutions or deletions may increase the pharmaceutical stability of the modified FGF-21 polypeptide. In some cases, the other additions, substitutions or deletions may increase the solubility (including but not limited to, when expressed in E. coli or other host cells) of the modified FGF-21 polypeptide. In some embodiments the additions, substitutions or deletions may increase the polypeptide solubility following expression in E. coli or other recombinant host cells. In some embodiments sites are selected for substitution with a naturally encoded or non-natural amino acid in addition to another site for incorporation of a non-natural amino acid that results in increasing the polypeptide solubility following expression in E. coli or other recombinant host cells. In some embodiments, the modified FGF-21 polypeptides comprise another addition, substitution or deletion that modulates affinity for the FGF-21 polypeptide receptor, binding proteins, or associated ligand, modulates signal transduction after binding to the FGF-21 receptor, modulates circulating half-life, modulates release or bioavailability, facilitates purification, or improves or alters a particular route of administration. In some embodiments, the modified FGF-21 polypeptides comprise an addition, substitution or deletion that increases the affinity of the modified FGF-21 for its receptor. Similarly, modified FGF-21 polypeptides can comprise chemical or enzyme cleavage sequences, protease cleavage sequences, reactive groups, antibody-binding domains (including but not limited to, FLAG or poly-His) or other affinity based sequences (including, but not limited to, FLAG, poly-His, GST, etc.) or linked molecules (including, but not limited to, biotin) that improve detection (including, but not limited to, GFP), purification, transport through tissues or cell membranes, prodrug release or activation, modified FGF-21 size reduction, or other traits of the polypeptide.

For sequences of FGF-21 that lack a leader sequence, see SEQ ID NO: 1, SEQ ID NO: 2 and SEQ ID NO: 5 herein. For sequences of FGF-21 with a leader sequence, see SEQ ID NO: 3, SEQ ID NO: 4, SEQ ID NO: 6 and SEQ ID NO: 7 herein. In some embodiments, FGF-21 polypeptides of the disclosure are substantially identical to SEQ ID NOs: 1-7 or any other sequence of a FGF-21 polypeptide. Multiple polymorphisms of FGF-21 have been identified. Leucine or proline have been described at the same position in U.S. Patent Publication No. 20010012628 and U.S. Pat. No. 6,716,626. N-terminal leader or signal sequences that differ by 1 amino acid (leucine) are shown in U.S. Pat. No. 6,716,626 and U.S. Patent Publication No. 20040259780. FGF-21 polypeptide variants or mutants include, but are not limited to, those disclosed in U.S. Pat. No. 6,716,626; U.S. Patent Publication Nos. 2005/0176631, 2005/0037457, 2004/0185494, 2004/0259780, 2002/0164713, and 2001/0012628; WO 01/36640; WO 03/011213; WO 03/059270; WO 04/110472; WO 05/061712; WO 05/072769; WO 05/091944; WO 05/113606; WO 06/028595; WO 06/028714; WO 06/050247; WO 06/065582; WO 06/078463; WO01/018172; WO09/149171; WO10/042747; WO12/066075; WO11/154349; WO13/052311; WO13/188181, which are incorporated by reference in their entirety herein.

The term "modified FGF-21 polypeptide" also includes biologically-active fragments, biologically active variants and stereoisomers of the naturally-occurring FGF-21 as well as agonist, mimetic, and antagonist variants of the naturally-occurring FGF-21 and polypeptide fusions thereof. Fusions comprising additional amino acids at the amino terminus, carboxyl terminus, or both, are encompassed by the term "modified FGF-21 polypeptide." Exemplary fusions include, but are not limited to, e.g., methionyl FGF-21 in which a methionine is linked to the N-terminus of FGF-21 resulting from the recombinant expression of the mature form of FGF-21 lacking the leader or signal peptide or portion thereof (a methionine is linked to the N-terminus of FGF-21 resulting from the recombinant expression, e.g. in E. coli), fusions for the purpose of purification (including, but not limited to, to poly-histidine or affinity epitopes), fusions with serum albumin binding peptides such as PKE adnectin and fusions with serum proteins such as serum albumin, and fusion proteins comprising FGF-21 and one or more other molecules ("fusion partner"), including but not limited to, serum albumin, Fc domain, immunoglobulin constant region, unstructured polypeptide, and adnectin, and a fragment thereof. Any such fragments can be prepared from the proteins by standard biochemical methods, or by expressing a polynucleotide encoding the fragment.

Except where indicated otherwise, in general the terms "FGF-21 polypeptide" "fibroblast growth factor 21" and "FGF-21" as used herein encompasses both unmodified (i.e., wild-type) FGF-21 and modified FGF-21 polypeptides.

The term "modified FGF-21 polypeptide" includes polypeptides conjugated to a polymer such as PEG and may optionally comprise one or more additional derivitizations of cysteine, lysine, or other residues. In addition, the modified FGF-21 polypeptide may comprise a linker or polymer, wherein the amino acid to which the linker or polymer is conjugated may be a non-natural amino acid according to the present disclosure, or may be conjugated to a naturally encoded amino acid utilizing techniques known in the art such as coupling to lysine or cysteine.

The term "modified FGF-21 polypeptide" also includes glycosylated modified FGF-21, such as but not limited to, polypeptides glycosylated at any amino acid position, N-linked or O-linked glycosylated forms of the polypeptide. Variants containing single nucleotide changes are also considered as biologically active variants of FGF-21 polypeptide. In addition, splice variants are also included. The term "modified FGF-21 polypeptide" also includes FGF-21 polypeptide heterodimers, homodimers, heteromultimers, or homomultimers of any one or more unmodified or modified FGF-21 polypeptides or any other polypeptide, protein, carbohydrate, polymer, small molecule, linker, ligand, or other biologically active molecule of any type, linked by chemical means or expressed as a fusion protein, as well as polypeptide analogues containing, for example, specific deletions or other modifications yet maintain biological activity.

All references to amino acid positions in unmodified or modified FGF-21 described herein are based on the corresponding position in SEQ ID NO: 1, unless otherwise specified (i.e., when it is stated that the comparison is based on SEQ ID NO: 2, 3, 4, 5, 6, 7, or other FGF-21 sequence). For example, the amino acid at position 77 of SEQ ID NO: 1, is an arginine and the corresponding arginine is located in SEQ ID NO: 2 at position 87. Those of skill in the art will appreciate that amino acid positions corresponding to positions in SEQ ID NO: 1 can be readily identified in any other FGF-21 molecule such as SEQ ID NO: 2, 3, 4, 5, 6, and 7. Those of skill in the art will appreciate that amino acid positions corresponding to positions in SEQ ID NO: 1, 2, 3, 4, 5, 6, 7 or any other FGF-21 sequence can be readily identified in any other FGF-21 molecule such as FGF-21 fusions, variants, fragments, etc. For example, sequence alignment programs such as BLAST can be used to align and identify a particular position in a protein that corresponds with a position in SEQ ID NO: 1, 2, 3, 4, 5, 6, 7 or other FGF-21 sequence. Substitutions, deletions or additions of amino acids described herein in reference to SEQ ID NO: 1, 2, 3, 4, 5, 6, 7, or other FGF-21 sequence are intended to also refer to substitutions, deletions or additions in corresponding positions in FGF-21 fusions, variants, fragments, etc. described herein or known in the art and are expressly encompassed by the present disclosure.

The term "modified FGF-21 polypeptide" or "modified FGF-21" encompasses FGF-21 polypeptides comprising one or more amino acid substitutions, insertions or deletions. For example, modified FGF-21 polypeptides of the present disclosure may be comprised of modifications with one or more natural amino acids, optionally in conjunction with one or more non-natural amino acid modification. Exemplary substitutions, insertions or deletions in a wide variety of amino acid positions in FGF-21 polypeptides (including those described herein and others), including but not limited to substitutions that modulate pharmaceutical stability, that modulate one or more of the biological activities of the FGF-21 polypeptide, such as but not limited to, increase agonist activity, increase solubility of the polypeptide, decrease protease susceptibility, decrease deamidation, convert the polypeptide into an antagonist, reduce immunogenicity or toxicity, or facilitate purification or manufacturability, etc. and are encompassed by the term "modified FGF-21 polypeptide."

In some embodiments, the modified FGF-21 polypeptides further comprise an additional insertion, substitution or deletion that modulates biological activity of the modified FGF-21 polypeptide. For example, the additions, substitutions or deletions may modulate one or more properties or activities of modified FGF-21. For example, the additions, substitutions or deletions may modulate affinity for the FGF-21 polypeptide receptor, modulate circulating half-life, modulate therapeutic half-life, modulate stability of the polypeptide, modulate cleavage by proteases, modulate dose, modulate release or bio-availability, facilitate purification, decrease deamidation, improve shelf-life, or improve or alter a particular route of administration. Similarly, modified FGF-21 polypeptides may comprise protease cleavage sequences, reactive groups, antibody-binding domains (including but not limited to, FLAG or poly-His) or other affinity based sequences (including but not limited to, FLAG, poly-His, GST, etc.) or linked molecules (including but not limited to, biotin) that improve detection (including but not limited to, GFP), purification or other traits of the polypeptide.

The term "modified FGF-21 polypeptide" also encompasses homodimers, heterodimers, homomultimers, and heteromultimers that are formed via fusion partners, such as Fc domains, or that are linked, including but not limited to those linked directly via non-naturally encoded amino acid side chains, either to the same or different non-naturally encoded amino acid side chains, to naturally-encoded amino acid side chains, or indirectly via a linker. Exemplary linkers including but are not limited to, small organic compounds, water soluble polymers of a variety of lengths such as poly (ethylene glycol) or polydextran, or polypeptides of various lengths.

A "non-naturally encoded amino acid" refers to an amino acid that is not one of the 20 common amino acids or pyrrolysine or selenocysteine. Other terms that may be used synonymously with the term "non-naturally encoded amino acid" are "non-natural amino acid," "unnatural amino acid," "non-naturally occurring amino acid," and variously hyphenated and non-hyphenated versions thereof. The term "non-naturally encoded amino acid" also includes, but is not limited to, amino acids that occur by modification (e.g. post-translational modifications) of a naturally encoded amino acid (including but not limited to, the 20 common amino acids or pyrrolysine and selenocysteine) but are not themselves naturally incorporated into a growing polypeptide chain by the translation complex. Examples of such non-naturally encoded amino acids include, but are not limited to, N-acetylglucosaminyl-L-serine, N-acetylglucosaminyl-L-threonine, and O-phosphotyrosine.

An "amino terminus modification group" refers to any molecule that can be attached to the amino terminus of a polypeptide. Similarly, a "carboxy terminus modification group" refers to any molecule that can be attached to the carboxy terminus of a polypeptide. Terminus modification groups include, but are not limited to, various water soluble polymers, peptides or proteins such as serum albumin, Fc domain, immunoglobulin constant region, unstructured polypeptide, adnectin, or a fragment thereof, or other moieties that increase serum (in vivo) half-life of peptides.

The terms "functional group", "active moiety", "activating group", "leaving group", "reactive site", "chemically reactive group" and "chemically reactive moiety" are used in the art and herein to refer to distinct definable portions or units of a molecule. The terms are somewhat synonymous in the chemical arts and are used herein to indicate the portions of molecules that perform some function or activity and are reactive with other molecules.

The term "linkage" or "linker" is used herein to refer to groups or bonds that normally are formed as the result of a chemical reaction and typically are covalent linkages. Hydrolytically stable linkages means that the linkages are substantially stable in water and do not react with water at useful pH values, including but not limited to, under physiological conditions for an extended period of time, perhaps even indefinitely. Hydrolytically unstable or degradable linkages mean that the linkages are degradable in water or in aqueous solutions, including for example, blood. Enzymatically unstable or degradable linkages mean that the linkage can be degraded by one or more enzymes. As understood in the art, PEG and related polymers may include degradable linkages in the polymer backbone or in the linker group between the polymer backbone and one or more of the terminal functional groups of the polymer molecule. For example, ester linkages formed by the reaction of PEG carboxylic acids or activated PEG carboxylic acids with alcohol groups on a biologically active agent generally hydrolyze under physiological conditions to release the agent. Other hydrolytically degradable linkages include, but are not limited to, carbonate linkages; imine linkages resulted from reaction of an amine and an aldehyde; phosphate ester linkages formed by reacting an alcohol with a phosphate group; hydrazone linkages which are reaction product of a hydrazide and an aldehyde; acetal linkages that are the reaction product of an aldehyde and an alcohol; orthoester linkages that are the reaction product of a formate and an alcohol; peptide linkages formed by an amine group, including but not limited to, at an end of a polymer such as PEG, and a carboxyl group of a peptide; and oligonucleotide linkages formed by a phosphoramidite group, including but not limited to, at the end of a polymer, and a 5' hydroxyl group of an oligonucleotide.

The term "biologically active molecule", "biologically active moiety" or "biologically active agent" when used herein means any substance which can affect any physical or biochemical properties of a biological system, pathway, molecule, or interaction relating to a living organism. In particular, as used herein, biologically active molecules include, but are not limited to, any substance intended for diagnosis, cure, mitigation, treatment, or prevention of disease in humans or other animals, or to otherwise enhance physical or mental well-being of humans or animals. Examples of biologically active molecules include, but are not limited to, peptides, proteins, enzymes, small molecule drugs, carbohydrates, inorganic atoms or molecules, dyes, lipids, nucleosides, radionuclides, oligonucleotides, toxoids, toxins, polysaccharides, nucleic acids, peptides, polypeptides, proteins, and portions thereof obtained or derived from viruses, bacteria, insects, animals or any other cell or cell type, liposomes, microparticles and micelles.

The term "substituents" includes but is not limited to "non-interfering substituents". "Non-interfering substituents" are those groups that yield stable compounds. Suitable non-interfering substituents or radicals include, but are not limited to, halo, $C_1$-$C_{10}$ alkyl, $C_2$-$C_{10}$ alkenyl, $C_2$-$C_{10}$ alkynyl, $C_1$-$C_{10}$ alkoxy, $C_1$-$C_{12}$ aralkyl, $C_1$-$C_{12}$ alkaryl, $C_3$-$C_{12}$ cycloalkyl, $C_3$-$C_{12}$ cycloalkenyl, phenyl, substituted phenyl, toluoyl, xylenyl, biphenyl, $C_2$-$C_{12}$ alkoxyalkyl, $C_2$-$C_{12}$ alkoxyaryl, $C_7$-$C_{12}$ aryloxyalkyl, $C_7$-$C_{12}$ oxyaryl, $C_1$-$C_6$ alkylsulfinyl, $C_1$-$C_{10}$ alkylsulfonyl, —($CH_2$)$_m$—O—($C_1$-$C_{10}$ alkyl) wherein m is from 1 to 8, aryl, substituted aryl, substituted alkoxy, fluoroalkyl, heterocyclic radical, substituted heterocyclic radical, nitroalkyl, —$NO_2$, —CN, —NRC(O)—($C_1$-$C_{10}$ alkyl), —C(O)—($C_1$-$C_{10}$ alkyl), $C_2$-$C_{10}$ alkyl thioalkyl, —C(O)O—($C_1$-$C_{10}$ alkyl), —OH, —$SO_2$, =S, —COOH, —$NR_2$, carbonyl, —C(O)—($C_1$-$C_{10}$ alkyl)-CF3, —C(O)—CF3, —C(O)NR2, —($C_1$-$C_{10}$ aryl)-S—($C_6$-$C_{10}$ aryl), —C(O)—($C_1$-$C_{10}$ aryl), —($CH_2$)$_m$—O—(—($CH_2$)$_m$—O—($C_1$-$C_{10}$ alkyl) wherein each m is from 1 to 8, —C(O)$NR_2$, —C(S)$NR_2$, $SO_2NR_2$, —NRC(O)$NR_2$, —NRC(S) $NR_2$, salts thereof, and the like. Each R as used herein is H, alkyl or substituted alkyl, aryl or substituted aryl, aralkyl, or alkaryl.

As used herein, the term "water soluble polymer" refers to any polymer that is soluble in aqueous solvents. Linkage of water soluble polymers to modified FGF-21 polypeptides can result in changes including, but not limited to, increased or modulated serum (in vivo) half-life, or increased or modulated therapeutic half-life relative to the unmodified form, modulated immunogenicity or toxicity, modulated physical association characteristics such as aggregation and multimer formation, altered receptor binding, altered binding to one or more binding partners, and altered receptor dimerization or multimerization. The water soluble polymer may or may not have its own biological activity, and may be utilized as a linker for attaching modified FGF-21 to other substances, including but not limited to one or more unmodified or modified FGF-21 polypeptides, or one or more biologically active molecules. Suitable polymers include, but are not limited to, polyethylene glycol, polyethylene glycol propionaldehyde, mono C1-C10 alkoxy or aryloxy derivatives thereof (described in U.S. Pat. No. 5,252,714 which is incorporated by reference herein), monomethoxypolyethylene glycol, discrete PEG, polyvinyl pyrrolidone, polyvinyl alcohol, polyamino acids, divinylether maleic anhydride, N-(2-Hydroxypropyl)-methacrylamide, dextran, dextran derivatives including dextran sulfate, polypropylene glycol, polypropylene oxide/ethylene oxide copolymer, polyoxyethylated polyol, heparin, heparin fragments, polysaccharides, oligosaccharides, glycans, cellulose and cellulose derivatives, including but not limited to methylcellulose and carboxymethyl cellulose, starch and starch derivatives, polypeptides, polyalkylene glycol and derivatives thereof, copolymers of polyalkylene glycols and derivatives thereof, polyvinyl ethyl ethers, and alpha-beta-poly[(2-hydroxyethyl)-DL-aspartamide, and the like, or mixtures thereof. Examples of such water soluble polymers include, but are not limited to, polyethylene glycol and serum albumin.

As used herein, the term "polyalkylene glycol" (PEG) or "poly(alkene glycol)" refers to polyethylene glycol (poly (ethylene glycol)), polypropylene glycol, polybutylene glycol, and derivatives thereof. The term "polyalkylene glycol" encompasses both linear and branched polymers and average molecular weights of between 0.1 kDa and 100 kDa. Other exemplary embodiments are listed, for example, in commercial supplier catalogs, such as Shearwater Corporation's catalog "Polyethylene Glycol and Derivatives for Biomedical Applications" (2001).

As used herein, the terms "modulated serum half-life" or "modulated in vivo half-life" and similar terms refer to the positive or negative change in circulating half-life of a modified FGF-21 relative to a comparator such as its non-modified form. Serum half-life can be measured by taking blood samples at various time points after administration of a modified FGF-21, and determining the concentration of that molecule in each sample. Correlation of the serum concentration with time allows calculation of the serum half-life. Increased serum (in vivo) half-life desirably may be at least about two-fold, but a smaller increase may be useful, for example where it enables a satisfactory dosing regimen or avoids a toxic effect. In some embodiments, the increase may be at least about three-fold, at least about five-fold, or at least about ten-fold.

The term "modulated therapeutic half-life" as used herein means the positive or negative change in the serum or in vivo half-life of the therapeutically effective amount of the modified FGF-21 polypeptide described herein, relative to a comparator such as its non-modified form or the wildtype FGF-21. Therapeutic half-life is measured by measuring pharmacokinetic and/or pharmacodynamic properties of the molecule at various time points after administration. Increased therapeutic half-life desirably enables a particular beneficial dosing regimen, a particular beneficial total dose, or avoids an undesired effect. In some embodiments, the increased therapeutic half-life results from increased potency, increased or decreased binding of the modified molecule to its target, increased or decreased breakdown of the molecule by enzymes such as proteases, or an increase or decrease in another parameter or mechanism of action of the non-modified molecule or an increase or decrease in receptor-mediated clearance of the molecule.

The term "isolated," when applied to a nucleic acid or protein, denotes that the nucleic acid or protein is free of at least some of the cellular components with which it is associated in the natural state, or that the nucleic acid or protein has been concentrated to a level greater than the concentration of its in vivo or in vitro production. It can be in a homogeneous state. Isolated substances can be in either a dry or semi-dry state, or in solution, including but not limited to, an aqueous solution. It can be a component of a pharmaceutical composition that comprises additional pharmaceutically acceptable carriers and/or excipients. Purity and homogeneity are typically determined using analytical chemistry techniques such as polyacrylamide gel electrophoresis or high performance liquid chromatography. A protein which is the predominant species present in a preparation is substantially purified. In particular, an isolated gene is separated from open reading frames which flank the gene and encode a protein other than the gene of interest. The term "purified" denotes that a nucleic acid or protein gives rise to substantially one band in an electrophoretic gel. Particularly, it may mean that the nucleic acid or protein is at least 85% pure, at least 90% pure, at least 95% pure, at least 99% or greater pure.

The term "nucleic acid" refers to deoxyribonucleotides, deoxyribonucleosides, ribonucleosides, or ribonucleotides and polymers thereof in either single- or double-stranded form. Unless specifically limited, the term encompasses nucleic acids containing known analogues of natural nucleotides which have similar binding properties as the reference nucleic acid and are metabolized in a manner similar to naturally occurring nucleotides. Unless specifically limited otherwise, the term also refers to oligonucleotide analogs including PNA (peptidonucleic acid), analogs of DNA used in antisense technology (phosphorothioates, phosphoroamidates, and the like). Unless otherwise indicated, a particular nucleic acid sequence also implicitly encompasses conservatively modified variants thereof (including but not limited to, degenerate codon substitutions) and complementary sequences as well as the sequence explicitly indicated.

The terms "polypeptide," "peptide" and "protein" are used interchangeably herein to refer to a polymer of amino acid residues. That is, a description directed to a polypeptide applies equally to a description of a peptide and a description of a protein, and vice versa. The terms apply to naturally occurring amino acid polymers as well as amino acid polymers in which one or more amino acid residues is a non-naturally encoded amino acid. As used herein, the terms encompass amino acid chains of any length, including full length proteins, wherein the amino acid residues are linked by covalent peptide bonds.

"Conservatively modified variants" refers to amino acid sequences containing conservative substitutions. Exemplary conservatively modified variants include substitutions, deletions or insertions to a nucleic acid, peptide, polypeptide, or protein sequence which alters, adds or deletes a single amino acid or a small percentage of amino acids in the polypeptide sequence or encoded polypeptide sequence, e.g., up to 1, 2, 3, 4, or 5 amino acids, or up to 0.5%, 1%, 1.5%, 2%, 2.5%, or 3.5% of the amino acids in the polypeptide sequence or encoded polypeptide sequence, which optionally may be or may include substitution of amino acid(s) with chemically similar amino acid(s). Conservative substitution tables providing functionally similar amino acids are known to those of ordinary skill in the art. Such conservatively modified variants are in addition to and do not exclude polymorphic variants, interspecies homologs, and alleles of the disclosed modified FGF-21 polypeptides.

Conservative substitution tables providing functionally similar amino acids are known to those of ordinary skill in the art. The following eight groups each contain amino acids that are conservative substitutions for one another:
1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)
(see, e.g., Creighton, *Proteins: Structures and Molecular Properties* (W H Freeman & Co.; 2nd edition (December 1993))

The terms "identical" or percent "identity," in the context of two or more nucleic acids or polypeptide sequences, refer to two or more sequences or subsequences that are the same. Sequences are "substantially identical" if they have a percentage of amino acid residues or nucleotides that are the same (i.e., about 60% identity, about 65%, about 70%, about 75%, about 80%, about 85%, about 90%, about 95%, about 96%, about 97%, about 98%, about 99%, identity over a specified region), when compared and aligned for maximum correspondence over a comparison window, or designated region as measured using one of the following sequence comparison algorithms (or other algorithms available to persons of ordinary skill in the art) or by manual alignment and visual inspection. The identity may exist over a region or comparison window that is at least about 50 amino acids or nucleotides in length, or over a region that is 75-100 amino acids or nucleotides in length, or, where not specified, across the entire sequence of a polynucleotide or polypeptide. A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Examples of algorithms that may be suitable for determining percent sequence identity and sequence similarity are the BLAST and BLAST 2.0 algorithms, which are described in Altschul et al. (1997) *Nuc. Acids Res.* 25:3389-3402, and Altschul et al. (1990) *J. Mol. Biol.* 215:403-410, respectively, as well as the Smith-Waterman (Smith and Waterman, J Mol Biol. 1981 Mar. 25; 147(1):195-7), or Needleman-Wunsch (Needleman and Wunsch, J Mol Biol. 1970 March; 48(3):443-53) algorithms, which may be run with the default parameters, e.g., as described in those respective publications.

The term "subject" as used herein, refers to an animal, in some embodiments a mammal, and in other embodiments a human, who is the object of treatment, observation or experiment. An animal may be a companion animal (e.g., dogs, cats, and the like), farm animal (e.g., cows, sheep, pigs, horses, and the like) or a laboratory animal (e.g., rats, mice, guinea pigs, and the like).

The term "effective amount" as used herein refers to that amount of the compound (e.g., a modified FGF-21 polypeptide described herein) being administered which may relieve to some extent one or more of the symptoms of the disease, condition or disorder being treated. Compositions containing the modified FGF-21 polypeptide described herein can be administered for prophylactic, enhancing, and/or therapeutic treatments.

The terms "enhance" or "enhancing" means to increase or prolong either in potency or duration a desired effect. Thus, in regard to enhancing the effect of therapeutic agents, the term "enhancing" refers to the ability to increase or prolong, either in potency or duration, the effect of other therapeutic agents on a system.

The term "modified," as used herein refers to any changes made to a given polypeptide, such as changes to the length of the polypeptide, the amino acid sequence, chemical structure, co-translational modification, or post-translational modification of a polypeptide. The form "(modified)" term means that the polypeptides being discussed are optionally modified, that is, the polypeptides under discussion can be modified or unmodified.

The term "post-translationally modified" refers to any modification of a natural or non-natural amino acid that occurs to such an amino acid after it has been incorporated into a polypeptide chain. The term encompasses, by way of example only, co-translational in vivo modifications, co-translational in vitro modifications (such as in a cell-free translation system), post-translational in vivo modifications, and post-translational in vitro modifications.

In prophylactic applications, compositions containing the modified FGF-21 polypeptide are administered to a patient susceptible to or otherwise at risk of a particular disease, disorder or condition. Such an amount is defined to be a "prophylactically effective amount."

In therapeutic applications, compositions comprising the modified non-natural amino acid polypeptide are administered to a patient already suffering from a disease, condition or disorder, in an amount sufficient to cure or at least partially arrest or alleviate the symptoms of the disease, disorder or condition. Such an amount is defined to be a "therapeutically effective amount," and may depend on the severity and course of the disease, disorder or condition, previous therapy, the patient's health status and response to the drugs, and the judgment of the treating physician. It is considered well within the skill of the art for one to determine such therapeutically effective amounts by routine experimentation (e.g., a dose escalation clinical trial).

The term "treating" is used to refer to prophylactic and/or therapeutic treatments.

Non-naturally encoded amino acid polypeptides presented herein may include isotopically-labelled compounds with one or more atoms replaced by an atom having an atomic mass or mass number different from the atomic mass or mass number usually found in nature.

All isomers including but not limited to diastereomers, enantiomers, and mixtures thereof are considered as part of the compositions described herein. In additional or further embodiments, the non-naturally encoded amino acid polypeptides are metabolized upon administration to an organism in need to produce a metabolite that is then used to produce a desired effect, including a desired therapeutic effect. In further or additional embodiments are active metabolites of non-naturally encoded amino acid polypeptides.

I. Overview

Modified FGF-21 molecules comprising an internal deletion and optionally comprising at least one unnatural amino acid are provided in the disclosure. Exemplary embodiments of modified FGF-21 polypeptides comprising an internal deletion are demonstrated to exhibit at least one advantageous properties, including, but not limited to, increased thermal stability, improved solubility, decreased deamination, improved manufacturability, improved in vivo half-life of a full-length biologically active form, while retaining a level of biological activity comparable to an FGF-21 polypeptide without the internal deletion.

Deamidation was mitigated and shelf-life and purity improved in modified FGF-21 polypeptides containing a deleted region and optionally replaced with a peptide (see FIG. 1). Exemplary modified sequences were shown to mitigate a deamidation event that can occur during storage of the molecule. In addition to deamidation mitigation, this modification also increased the thermal stability and/or solubility of the protein in solution and further minimized protein aggregation propensities relative to wild-type FGF-21 or FGF-21 polypeptides lacking this deletion. The decreased deamidation, increased thermal stability, increased solubility, and/or decreased aggregation indicate superior formulation characteristics, such as longer shelf-life and greater purity, as well as formulation at greater concentration. Additionally, mitigating the propensity for deamidation allows a greater range of formulation options; otherwise, formulation conditions would need to be selected in order to decrease deamidation, potentially resulting in other undesirable formulation characteristics. Furthermore, it is unpredictable and unexpected that a modified FGF-21 polypeptide comprising an internal deletion of between 5 and 19 contiguous amino acids and a replacement peptide, may retain the biological function of FGF-21 and have at least one of decreased deamidation, increased thermal stability, increased solubility, and decreased aggregation.

A further exemplary modification mitigates the in vivo proteolytic clipping of ten C-terminal amino acids from the protein. This modification extends the blood half life of the intact, active molecule resulting in decreases in overall dose, and less frequent dosing. An exemplary modification that mitigates proteolytic clipping is the point mutation, G170E, though other modifications may also be utilized.

In some embodiments, the disclosure provides a modified FGF-21 polypeptide comprising a polypeptide having an amino acid sequence selected from SEQ ID NOs: 1-7, except that said amino acid sequence may comprise: (i) an internal deletion of between 2 and 19 amino acids (such as between 5 and 19 amino acids), wherein said internal deletion is within a region corresponding to amino acids 116 to 134 of SEQ ID NO:1, wherein said internal deletion is replaced by a replacement peptide having a length of between 0 and 12 amino acids; and (ii) 9 or fewer additional amino acid substitutions, deletions, and/or insertions.

In some embodiments, the modified FGF-21 polypeptide described herein may comprise a polypeptide having an amino acid sequence that may contain at least one non-naturally encoded amino acid. In some embodiments, said at least one non-naturally encoded amino acid is at a position corresponding to amino acid 72, 77, 86, 87, 91, 108, 110, 126, 131, or 146 of SEQ ID NO: 1. In some embodiments, said at least one non-naturally encoded amino acid is at a position corresponding to amino acid 77, 91, 108 or 131 of SEQ ID NO: 1. In some embodiments, said at least one non-naturally encoded amino acid is at a position corresponding to amino acid 108 in SEQ ID NO: 1. In some embodiments, said at least one non-naturally encoded amino acid is at a position corresponding to amino acid 72 in SEQ ID NO: 1. In some embodiments, said at least one non-naturally encoded amino acid is at a position corresponding to amino acid 77 in SEQ ID NO: 1. In some embodiments, said at least one non-naturally encoded amino acid is at a position corresponding to amino acid 86 in SEQ ID NO: 1. In some embodiments, said at least one non-naturally encoded amino acid is at a position corresponding to amino acid 87 in SEQ ID NO: 1. In some embodiments, said at least one non-naturally encoded amino acid is at a position corresponding to amino acid 91 in SEQ ID NO: 1. In some embodiments, said at least one non-naturally encoded amino acid is at a position corresponding to amino acid 110 in SEQ ID NO: 1. In some embodiments, said at least one non-naturally encoded amino acid is at a position corresponding to amino acid 126 in SEQ ID NO: 1. In some embodiments, said at least one non-naturally encoded amino acid is at a position corresponding to amino acid 131 in SEQ ID NO: 1. In some embodiments, said at least one non-naturally encoded amino acid is at a position corresponding to amino acid 146 in SEQ ID NO: 1. In some embodiments, said at least one non-naturally encoded amino acid is a phenylalanine derivative. In some embodiments, said at least one non-naturally encoded amino acid may be a para-substituted, ortho-substituted, or meta-substituted phenylalanine derivative. In some embodiments, said at least one non-naturally encoded amino acid is para-acetyl-L-phenylalanine. In some embodiments, said at least one non-naturally encoded amino acid is para-acetyl-L-phenylalanine incorporated at the position corresponding to amino acid 108 in SEQ ID NO:1.

In some embodiments, the disclosure provides a modified FGF-21 polypeptide comprising a polypeptide having an amino acid sequence selected from SEQ ID NOs: 1-7, except that said amino acid sequence may comprise: (i) an internal deletion of between 2 and 19 amino acids (such as between 5 and 19 amino acids), wherein said internal deletion is within a region corresponding to amino acids 116 to 134 of SEQ ID NO:1, wherein said internal deletion is replaced by a replacement peptide having a length of between 0 and 12 amino acids; (ii) 9 or fewer additional amino acid substitutions, deletions, and/or insertions; (iii) a non-naturally encoded amino acid at the position corresponding to amino acid 108 of SEQ ID NO:1, which may comprise a para-substituted, ortho-substituted, or meta-substituted phenylalanine derivate, such as para-acetyl-L-phenylalanine.

In some embodiments, said modified FGF-21 polypeptide may comprise a substitution of glutamic acid for glycine at the position corresponding to amino acid 170 of SEQ ID NO: 1.

In some embodiments, said internal deletion may comprise or consist of a region corresponding to amino acids 119-130 of SEQ ID NO:1. In some embodiments, said modified FGF-21 polypeptide may be linked to a polymer, water soluble polymer, or poly(ethylene glycol), such as a poly(ethylene glycol) having an average molecular weight of about 30 kDa. In some embodiments, said replacement peptide has the sequence G, GG, SG, GSG, GGH, or SGG. In some embodiments, said replacement peptide has the sequence GSG.

In some embodiments, the modified FGF-21 polypeptide described herein may comprise a polypeptide having an amino acid sequence that may contain 18, 17, 16, 15, 14, 13, 12, 11, 10, 9, 8, 7, 6, 5, 4, 3, 2, 1, or fewer additional amino acid substitutions, deletions, and/or insertions. In some embodiments, the modified FGF-21 polypeptide described herein may comprise a polypeptide having an amino acid sequence that may contain 8 or fewer additional amino acid substitutions, deletions, and/or insertions. In some embodiments, the modified FGF-21 polypeptide described herein may comprise a polypeptide having an amino acid sequence that may contain 7 or fewer additional amino acid substitutions, deletions, and/or insertions. In some embodiments, the modified FGF-21 polypeptide described herein may comprise a polypeptide having an amino acid sequence that may contain 6 or fewer additional amino acid substitutions, deletions, and/or insertions. In some embodiments, the modified FGF-21 polypeptide described herein may comprise a polypeptide having an amino acid sequence that may contain 5 or fewer additional amino acid substitutions, deletions, and/or insertions. In some embodiments, the modified FGF-21 polypeptide described herein may comprise a polypeptide having an amino acid sequence that may contain 4 or fewer additional amino acid substitutions, deletions, and/or insertions. In some embodiments, the modified FGF-21 polypeptide described herein may comprise a polypeptide having an amino acid sequence that may contain 3 or fewer additional amino acid substitutions, deletions, and/or insertions. In some embodiments, the modified FGF-21 polypeptide described herein may comprise a polypeptide having an amino acid sequence that may contain 2 or fewer additional amino acid substitutions, deletions, and/or insertions. In some embodiments, the modified FGF-21 polypeptide described herein may comprise a polypeptide having an amino acid sequence that may contain 1 additional amino acid substitution, deletion, and/or insertion. In some embodiments, the modified FGF-21 polypeptide described herein may comprise a polypeptide having an amino acid sequence that may contain a substitution or deletion of the amino acid corresponding to amino acid G170 of SEQ ID NO: 1. In some embodiments, the modified FGF-21 polypeptide described herein may comprise a polypeptide having an amino acid sequence that may contain a substitution of glutamic acid for glycine at the position corresponding to amino acid 170 of SEQ ID NO: 1. In some embodiments, the modified FGF-21 polypeptide described herein may comprise a polypeptide having an amino acid sequence that may contain no additional amino acid substitutions, deletions, and/or insertions.

In some embodiments, the modified FGF-21 polypeptide described herein may comprise a polypeptide having an amino acid sequence containing an internal deletion of between 4 and 19, between 4 and 18, between 4 and 17, between 4 and 16 between 4 and 15, between 4 and 14, between 4 and 13, between 4 and 12, between 4 and 11, between 4 and 10, between 4 and 9, between 4 and 8, between 4 and 7, or between 4 and 6 amino acids. In some embodiments, said internal deletion may be between 4 and 14 amino acids. In some embodiments, said internal deletion may be between 4 and 12 amino acids. In some embodiments, said internal deletion may be between 4 and 10 amino acids. In some embodiments, said internal deletion may be between 4 and 8 amino acids. In some embodiments, said internal deletion may be between 4 and 6 amino acids.

In some embodiments, said internal deletion may be between 5 and 19, between 5 and 18, between 5 and 17, between 5 and 16, between 5 and 15, between 5 and 14, between 5 and 13, between 5 and 12, between 5 and 11, between 5 and 10, between 5 and 9, between 5 and 8, between 5 and 7, or between 5 and 6 amino acids. In some embodiments, said internal deletion may be between 5 and 14 amino acids. In some embodiments, said internal deletion may be between 5 and 12 amino acids.

In some embodiments, said internal deletion may be between 6 and 19, between 6 and 18, between 6 and 17, between 6 and 16, between 6 and 15, between 6 and 14, between 6 and 13, between 6 and 12, between 6 and 11, between 6 and 10, between 6 and 9, between 6 and 8, or between 6 and 7 amino acids. In some embodiments, said internal deletion may be between 6 and 14 amino acids. In some embodiments, said internal deletion may be between 6 and 12 amino acids.

In some embodiments, said internal deletion may be between 7 and 19, between 7 and 18, between 7 and 17, between 7 and 16, between 7 and 15, between 7 and 14, between 7 and 13, between 7 and 12, between 7 and 11, between 7 and 10, between 7 and 9, or between 7 and 8 amino acids. In some embodiments, said internal deletion may be between 7 and 14 amino acids. In some embodiments, said internal deletion may be between 7 and 12 amino acids.

In some embodiments, said internal deletion may be between 8 and 19 amino acids. In some embodiments, said internal deletion may be between 8 and 14 amino acids. In some embodiments, said internal deletion may be between 8 and 12 amino acids.

In some embodiments, the modified FGF-21 polypeptide described herein may comprise a polypeptide having an amino acid sequence that may contain an internal deletion of 12 amino acids. In some embodiments, the modified FGF-21 polypeptide described herein may comprise a polypeptide having an amino acid sequence that may contain an internal deletion of 13 amino acids.

In some embodiments, the internal deletion described herein may comprise the position corresponding to amino acid 121 of SEQ ID NO:1.

In some embodiments, the modified FGF-21 polypeptide described herein may comprise a polypeptide having an amino acid sequence that may contain an internal deletion, wherein:
i) said internal deletion is within or consists of a region corresponding to amino acid 116 to amino acid 121, 122, 123, 124, 125, 126, 127, 128, 129, 130, 131, 132, 133, or 134 of SEQ ID NO:1;
ii) said internal deletion is within or consists of a region corresponding to amino acid 117 to amino acid 121, 122, 123, 124, 125, 126, 127, 128, 129, 130, 131, 132, 133, or 134 of SEQ ID NO:1;
iii) said internal deletion is within or consists of a region corresponding to amino acid 118 and to amino acid 121, 122, 123, 124, 125, 126, 127, 128, 129, 130, 131, 132, 133, or 134 of SEQ ID NO:1;
iv) said internal deletion is within or consists of a region corresponding to amino acid 119 to amino acid 121, 122, 123, 124, 125, 126, 127, 128, 129, 130, 131, 132, 133, or 134 of SEQ ID NO: 1;
v) said internal deletion is within or consists of a region corresponding to amino acid 120 to amino acid 121, 122, 123, 124, 125, 126, 127, 128, 129, 130, 131, 132, 133, or 134 of SEQ ID NO:1; or
vi) said internal deletion is within or consists of a region corresponding to amino acid 121 to amino acid 122, 123, 124, 125, 126, 127, 128, 129, 130, 131, 132, 133, or 134 of SEQ ID NO:1.

In some embodiments, the modified FGF-21 polypeptide described herein may comprise a polypeptide having an amino acid sequence that may contain an internal deletion, wherein:
i) said internal deletion is within or consists of a region corresponding to amino acid 122 to amino acid 126, 127, 128, 129, 130, 131, 132, 133, or 134 of SEQ ID NO:1;
ii) said internal deletion is within or consists of a region corresponding to amino acid 123 to amino acid 127, 128, 129, 130, 131, 132, 133, or 134 of SEQ ID NO:1;
iii) said internal deletion is within or consists of a region corresponding to amino acid 124 to amino acid 128, 129, 130, 131, 132, 133, or 134 of SEQ ID NO:1;
iv) said internal deletion is within or consists of a region corresponding to amino acid 125 to amino acid 129, 130, 131, 132, 133, or 134 of SEQ ID NO:1;
v) said internal deletion is within or consists of a region corresponding to amino acid 126 to amino acid 130, 131, 132, 133, or 134 of SEQ ID NO:1;
vi) said internal deletion is within or consists of a region corresponding to amino acid 127 to amino acid 131, 132, 133, or 134 of SEQ ID NO:1;
vii) said internal deletion is within or consists of a region corresponding to amino acid 128 to amino acid 132, 133, or 134 of SEQ ID NO:1;
viii) said internal deletion is within or consists of a region corresponding to amino acid 129 to amino acid 133, or 134 of SEQ ID NO:1; or
ix) said internal deletion is within or consists of a region corresponding to amino acid 130 to amino acid 134 of SEQ ID NO:1.

In some embodiments, the modified FGF-21 polypeptide described herein may comprise a polypeptide having an amino acid sequence that may contain an internal deletion, wherein:
i) said internal deletion is within or consists of a region corresponding to amino acid 116 to amino acid 117, 118, 119, 120, 121, 122, 123, 124, 125, 126, 127, 128, 129, 130, 131, 132, 133, or 134 of SEQ ID NO:1;
ii) said internal deletion is within or consists of a region corresponding to amino acid 117 to amino acid 118, 119, 120, 121, 122, 123, 124, 125, 126, 127, 128, 129, 130, 131, 132, 133, or 134 of SEQ ID NO:1;
iii) said internal deletion is within or consists of a region corresponding to amino acid 118 to amino acid 119, 120, 121, 122, 123, 124, 125, 126, 127, 128, 129, 130, 131, 132, 133, or 134 of SEQ ID NO:1;

iv) said internal deletion is within or consists of a region corresponding to amino acid 119 to amino acid 120, 121, 122, 123, 124, 125, 126, 127, 128, 129, 130, 131, 132, 133, or 134 of SEQ ID NO:1;

v) said internal deletion is within or consists of a region corresponding to amino acid 120 to amino acid 121, 122, 123, 124, 125, 126, 127, 128, 129, 130, 131, 132, 133, or 134 of SEQ ID NO:1;

vi) said internal deletion is within or consists of a region corresponding to amino acid 121 to amino acid 122, 123, 124, 125, 126, 127, 128, 129, 130, 131, 132, 133, or 134 of SEQ ID NO:1;

vii) said internal deletion is within or consists of a region corresponding to amino acid 122 to amino acid 123, 124, 125, 126, 127, 128, 129, 130, 131, 132, 133, or 134 of SEQ ID NO:1;

viii) said internal deletion is within or consists of a region corresponding to amino acid 123 to amino acid 124, 125, 126, 127, 128, 129, 130, 131, 132, 133, or 134 of SEQ ID NO:1;

ix) said internal deletion is within or consists of a region corresponding to amino acid 124 to amino acid 125, 126, 127, 128, 129, 130, 131, 132, 133, or 134 of SEQ ID NO:1;

x) said internal deletion is within or consists of a region corresponding to amino acid 125 to amino acid 126, 127, 128, 129, 130, 131, 132, 133, or 134 of SEQ ID NO:1;

xi) said internal deletion is within or consists of a region corresponding to amino acid 126 to amino acid 127, 128, 129, 130, 131, 132, 133, or 134 of SEQ ID NO:1;

xii) said internal deletion is within or consists of a region corresponding to amino acid 127 to amino acid 128, 129, 130, 131, 132, 133, or 134 of SEQ ID NO:1;

xiii) said internal deletion is within or consists of a region corresponding to amino acid 128 to amino acid 129, 130, 131, 132, 133, or 134 of SEQ ID NO:1;

xiv) said internal deletion is within or consists of a region corresponding to amino acid 129 to amino acid 130, 131, 132, 133, or 134 of SEQ ID NO:1;

xv) said internal deletion is within or consists of a region corresponding to amino acid 130 to amino acid 131, 132, 133, or 134 of SEQ ID NO:1;

xvi) said internal deletion is within or consists of a region corresponding to amino acid 131 to amino acid 132, 133, or 134 of SEQ ID NO:1;

xvii) said internal deletion is within or consists of a region corresponding to amino acid 132 to amino acid 133, or 134 of SEQ ID NO:1; or xviii) said internal deletion is within or consists of a region corresponding to amino acid 133 to amino acid 134 of SEQ ID NO:1.

In some embodiments, the modified FGF-21 polypeptide described herein may comprise a polypeptide having an amino acid sequence that may contain an internal deletion, wherein said internal deletion is within a region corresponding to amino acids 119-130 of SEQ ID NO:1. In some embodiments, the modified FGF-21 polypeptide described herein may comprise a polypeptide having an amino acid sequence that may contain an internal deletion, wherein said internal deletion comprises or consists of a region corresponding to amino acids 119-130 of SEQ ID NO:1.

In some embodiments, the disclosure provides a modified FGF-21 polypeptide comprising a polypeptide having an amino acid sequence selected from SEQ ID NOs: 1-7, except that said amino acid sequence may comprise: (i) an internal deletion of the region corresponding to amino acids 119-130 of SEQ ID NO:1, wherein said internal deletion is replaced by a replacement peptide having a length of between 0 and 12 amino acids; (ii) 9 or fewer additional amino acid substitutions, deletions, and/or insertions; and (iii) a non-naturally encoded amino acid at the position corresponding to amino acid 108 of SEQ ID NO:1, which may comprise a para-substituted, ortho-substituted, or meta-substituted phenylalanine derivate, such as para-acetyl-L-phenylalanine. Said modified FGF-21 polypeptide may comprise a substitution of glutamic acid for glycine at the position corresponding to amino acid 170 of SEQ ID NO: 1. Said modified FGF-21 polypeptide may be linked to a polymer, water soluble polymer, or poly(ethylene glycol), such as a poly(ethylene glycol) having an average molecular weight of about 30 kDa. In some embodiments, said replacement peptide has the sequence G, GG, SG, GSG, GGH, or SGG. In some embodiments, said replacement peptide has the sequence GSG.

In some embodiments, the modified FGF-21 polypeptide described herein may comprise a polypeptide having an amino acid sequence that may comprise a replacement polypeptide. In some embodiments, said replacement peptide has a length of 1, 2, 3, 4, 5, 6, 7, 8, 9, 10, 11 or 12 amino acids. In some embodiments, said replacement peptide has a length of 2-8 amino acids. In some embodiments, said replacement peptide has a length of 2-5 amino acids. In some embodiments, said replacement peptide has a length of 3 amino acids. In some embodiments, said replacement peptide comprises serine, histidine, and/or glycine residues. In some embodiments, said replacement peptide comprises serine and/or glycine residues. In some embodiments, said replacement peptide has the sequence G, GG, SG, GSG, GGH, or SGG. In some embodiments, said replacement peptide has the sequence GSG.

In some embodiments, the modified FGF-21 polypeptide described herein may comprise a polypeptide having an amino acid sequence that may comprise an internal deletion within the region corresponding to amino acids 119-130 of SEQ ID NO:1 and a replacement peptide having the sequence GSG.

In some embodiments, the disclosure provides a modified FGF-21 polypeptide comprising a polypeptide having an amino acid sequence selected from SEQ ID NOs: 1-7, except that said amino acid sequence may comprise: (i) an internal deletion of between 2 and 19 amino acids (such as between 5 and 19 amino acids), wherein said internal deletion is within a region corresponding to amino acids 116 to 134 of SEQ ID NO:1, wherein said internal deletion is replaced by a replacement peptide having the sequence G, GG, SG, GSG, GGH, or SGG; (ii) 9 or fewer additional amino acid substitutions, deletions, and/or insertions; (iii) a non-naturally encoded amino acid at the position corresponding to amino acid 108 of SEQ ID NO:1, which may comprise a para-substituted, ortho-substituted, or meta-substituted phenylalanine derivate, such as para-acetyl-L-phenylalanine. Said modified FGF-21 polypeptide may comprise a substitution of glutamic acid for glycine at the position corresponding to amino acid 170 of SEQ ID NO: 1. Said internal deletion may comprise or consist of a region corresponding to amino acids 119-130 of SEQ ID NO:1. Said modified FGF-21 polypeptide may be linked to a polymer, water soluble polymer, or poly(ethylene glycol), such as a poly(ethylene glycol) having an average molecular weight of about 30 kDa. In some embodiments, said replacement peptide has the sequence GSG.

In some embodiments, the modified FGF-21 polypeptide described herein may comprise a polypeptide having an amino acid sequence that may contain an internal deletion that comprises the region corresponding to amino acids 119-130 of SEQ ID NO:1, a replacement peptide having the sequence GSG, a substitution of glutamic acid for glycine at the position corresponding to amino acid 170 of SEQ ID NO: 1, and optionally a non-naturally encoded amino acid at the position corresponding to amino acid 108 of SEQ ID NO:1, which may comprise a para-substituted, ortho-substituted, or meta-substituted phenylalanine derivate, such as para-acetyl-L-phenylalanine.

In some embodiments, the modified FGF-21 polypeptide of described herein may comprise a polypeptide having an amino acid sequence that may have at least 90%, 95%, 96%, 97%, 98%, 99% identity to the polypeptide of SEQ ID NO: 202 with or without the N-terminal methionine. In some embodiments, said amino acid sequence may have at least 95% identity to the polypeptide of SEQ ID NO: 202 with or without the N-terminal methionine. In some embodiments, said amino acid sequence may have at least 97% identity to the polypeptide of SEQ ID NO: 202 with or without the N-terminal methionine. In some embodiments, said amino acid sequence may have at least 98% identity to the polypeptide of SEQ ID NO: 202 with or without the N-terminal methionine. In some embodiments, said amino acid sequence may have at least 99% identity to the polypeptide of SEQ ID NO: 202 with or without the N-terminal methionine. In some embodiments, said amino acid sequence may comprise or consist of the polypeptide of SEQ ID NO: 202 with or without the N-terminal methionine. In some embodiments, said amino acid sequence may comprise or consist of the polypeptide of SEQ ID NO: 202. In some embodiments, said amino acid sequence may comprise or consist of the polypeptide of SEQ ID NO: 202 without the N-terminal methionine.

In some embodiments, the modified FGF-21 polypeptide of described herein may comprise a polypeptide having an amino acid sequence that may have at least 90%, 95%, 96%, 97%, 98%, 99% identity to the polypeptide of SEQ ID NO: 102 with or without the N-terminal methionine. In some embodiments, said amino acid sequence may have at least 95% identity to the polypeptide of SEQ ID NO: 102 with or without the N-terminal methionine. In some embodiments, said amino acid sequence may have at least 97% identity to the polypeptide of SEQ ID NO: 102 with or without the N-terminal methionine. In some embodiments, said amino acid sequence may have at least 98% identity to the polypeptide of SEQ ID NO: 102 with or without the N-terminal methionine. In some embodiments, said amino acid sequence may have at least 99% identity to the polypeptide of SEQ ID NO: 102 with or without the N-terminal methionine. In some embodiments, said amino acid sequence may comprise or consist of the polypeptide of SEQ ID NO: 102 with or without the N-terminal methionine. In some embodiments, said amino acid sequence may comprise or consist of the polypeptide of SEQ ID NO: 102. In some embodiments, said amino acid sequence may comprise or consist of the polypeptide of SEQ ID NO: 102 without the N-terminal methionine.

In some embodiments, the modified FGF-21 polypeptide described herein may further comprise a fusion partner. In some embodiments, the modified FGF-21 polypeptide described herein may comprise a connecting peptide having a length of 0-50 amino acids between said amino acid sequence and a fusion partner. In some embodiments, the connecting peptide may have an amino acid sequence selected from SEQ ID NO:74-100, 301, and 350-383. In some embodiments, the connecting peptide may have the amino acid sequence GGGGGSGGGSGGGGS (SEQ ID NO:360).

In some embodiments, the modified FGF-21 polypeptide may further comprise a connecting peptide that links said amino acid sequence and said fusion partner. In some embodiments, the connecting peptide may have a length of between 0 and 100, between 2 and 80, between 2 and 60, between 2 and 50, between 2 and 40, between 2 and 30, between 2 and 20, between 2 and 10, between 2 and 8, between 2 and 6, or between 2 and 4 amino acids. In some embodiments, the connecting peptide may comprise or consist of an amino acid sequence selected from: SEQ ID NOs:74-100, 301, and 350-383.

In some embodiments, the connecting peptide may comprise or consist of the amino acid sequence GGGGGSGGGSGGGGS (SEQ ID NO:360).

In some embodiments, the fusion partner is selected from serum albumin, Fc domain, immunoglobulin constant region, unstructured polypeptide, and adnectin and fragments thereof. In some embodiments, the fusion partner comprises an immunoglobulin constant region or a modified immunoglobulin constant region. In some embodiments, the fusion partner may comprise an unstructured polypeptide, wherein said unstructured polypeptide comprises an XTEN or PAS polypeptide. In some embodiments, the PAS polypeptide may have an amino acid sequence selected from SEQ ID NOs: 310-316 or an amino acid sequence at least 70%, 75%, 80%, 85%, 90%, or 95% identical thereto.

In some embodiments, the fusion partner comprises an Fc domain or a fragment thereof. In some embodiments, the Fc domain may have an amino acid sequence at least 70%, 75%, 80%, 85%, 90%, 95%, 96%, 97%, 98%, or 99% identical to an amino acid sequence selected from SEQ ID NOs:302 and 323-335, or a fragment thereof, such as a polypeptide selected from SEQ ID NOs:303-309. In some embodiments, the fusion partner may comprise an Fc domain or Fc fragment having an amino acid sequence selected from SEQ ID NOs: 302 and 323-335. In some embodiments, the Fc domain may have an amino acid sequence at least 95% identical to an amino acid sequence selected from SEQ ID NOs:302 and 323-335, or a fragment thereof. In some embodiments, the Fc domain may have an amino acid sequence at least 90% identical to SEQ ID NOs:302. In some embodiments, the Fc domain may have an amino acid sequence at least 95% identical to SEQ ID NO:302. In some embodiments, the Fc domain may comprise the amino acid sequence of SEQ ID NO:302.

In some embodiments, the modified FGF-21 polypeptide may comprises or consists of a polypeptide at least 90%, 95%, 97%, 98%, 99%, or 100% identical to a polypeptide selected from: SEQ ID NOs:475-487. In some embodiments, the modified FGF-21 polypeptide comprises or consists of a polypeptide at least 90% identical to SEQ ID NO:475. In some embodiments, the modified FGF-21 polypeptide comprises or consists of a polypeptide at least 95% identical to SEQ ID NO:475. In some embodiments, the modified FGF-21 polypeptide comprises or consists of a polypeptide at least 96% identical to SEQ ID NO:475. In some embodiments, the modified FGF-21 polypeptide comprises or consists of a polypeptide at least 97% identical to SEQ ID NO:475. In some embodiments, the modified FGF-21 polypeptide comprises or consists of a polypeptide at least 98% identical to SEQ ID NO:475. In some embodiments, the modified FGF-21 polypeptide comprises or consists of a polypeptide at least 99% identical to SEQ ID NO:475. In some embodiments, the modified FGF-21 polypeptide comprises or consists of the polypeptide of SEQ ID NO:475.

In some embodiments, the fusion partner may comprise an adnectin. In some embodiments, the fusion partner may comprise an albumin-binding or PKE adnectin. In some embodiments, the PKE adnectin may comprise the polypeptide at least 70%, 80%, 90%, 95%, 96%, 97%, 98%, or 99% identical to SEQ ID NO: 320. In some embodiments, the PKE adnectin may comprise the polypeptide at least 90% identical to SEQ ID NO: 320. In some embodiments, the PKE adnectin may comprise the polypeptide of SEQ ID NO:320. In some embodiments, the modified FGF-21 polypeptide may comprise or consist of a polypeptide at least 90%, 95%, 97%, 98%, 99%, or 100% identical to a polypeptide selected from: SEQ ID NOs:401-423. In some embodiments, the modified FGF-21 polypeptide may comprise or consist of a polypeptide at least 95% identical to a polypeptide selected from: SEQ ID NOs:401-423. In some embodiments, the modified FGF-21 polypeptide may comprise or consist of a polypeptide selected from: SEQ ID NOs:401-423.

In some embodiments, the PKE adnectin may comprise the polypeptide at least 70%, 80%, 90%, 95%, 96%, 97%, 98%, or 99% identical to SEQ ID NO: 319. In some embodiments, the PKE adnectin may comprise the polypeptide at least 90% identical to SEQ ID NO: 319. In some embodiments, the PKE adnectin may comprise the polypeptide of SEQ ID NO:319. In some embodiments, the modified FGF-21 polypeptide may comprise or consist of a polypeptide at least 90%, 95%, 97%, 98%, 99%, or 100% identical to a polypeptide selected from: SEQ ID NOs: 452-474. In some embodiments, the modified FGF-21 polypeptide may comprise or consist of a polypeptide at least 95% identical to a polypeptide selected from: SEQ ID NOs: 452-474. In some embodiments, the modified FGF-21 polypeptide may comprise or consist of a polypeptide selected from: SEQ ID NOs: 452-474.

In some embodiments, the fusion partner comprises serum albumin or a fragment thereof. In some embodiments, the fusion partner comprises human serum albumin or a fragment thereof. In some embodiments, the fusion partner may comprise a polypeptide at least 90% identical to SEQ ID NO: 321 or 322. In some embodiments, the fusion partner may comprise the polypeptide of SEQ ID NO:321 or 322. In some embodiments, the modified FGF-21 polypeptide may comprise a polypeptide at least 90%, 95%, 97%, 98%, 99%, or 100% identical to a polypeptide selected from: SEQ ID NOs:424-432, 434-437, 440-443, and 446-451. In some embodiments, the modified FGF-21 polypeptide may comprise a polypeptide at least 95%, identical to a polypeptide selected from: SEQ ID NOs:424-432, 434-437, 440-443, and 446-451. In some embodiments, the modified FGF-21 polypeptide may comprise a polypeptide selected from: SEQ ID NOs:424-432, 434-437, 440-443, and 446-451.

In some embodiments, the disclosure provides a modified FGF-21 polypeptide comprising a polypeptide having an amino acid sequence selected from SEQ ID NOs: 1-7, except that said amino acid sequence may comprise: (i) an internal deletion of between 2 and 19 amino acids (such as between 5 and 19 amino acids), wherein said internal deletion is within a region corresponding to amino acids 116 to 134 of SEQ ID NO:1, wherein said internal deletion is replaced by a replacement peptide having a length of between 0 and 12 amino acids; and (ii) 9 or fewer additional amino acid substitutions, deletions, and/or insertions; wherein said modified FGF-21 polypeptide further comprises a fusion partner. Said fusion partner may comprise an Fc domain or a fragment thereof. Said modified FGF-21 polypeptide may comprise a substitution of glutamic acid for glycine at the position corresponding to amino acid 170 of SEQ ID NO: 1. Said internal deletion may comprise or consist of a region corresponding to amino acids 119-130 of SEQ ID NO:1. In some embodiments, said replacement peptide has the sequence G, GG, SG, GSG, GGH, or SGG. In some embodiments, said replacement peptide has the sequence GSG. In some embodiments, the modified FGF-21 polypeptide comprises a connecting peptide between said amino acid sequence and the fusion partner, wherein said connecting peptide comprises or consists of the amino acid sequence GGGGGSGGGSGGGS (SEQ ID NO:360).

In some embodiments, the modified FGF-21 polypeptide described herein may comprise a polypeptide having an amino acid sequence that may contain a non-naturally encoded amino acid that may be linked to a linker, polymer, biologically active molecule, peptide, polypeptide, or half-life extending moiety. In some embodiments, the modified FGF-21 polypeptide described herein may comprise a polypeptide having an amino acid sequence that may contain a non-naturally encoded amino acid that may be linked to a half-life extending moiety. In some embodiments, said half-life extending moiety comprises a water soluble polymer. In some embodiments, said half-life extending moiety is selected from poly(ethylene glycol) (PEG), monomethoxy PEG (mPEG), an unstructured polypeptide, an adnectin, serum albumin, human serum albumin, an Fc domain, an immunoglobulin constant region, a fragment of any of the foregoing, a lipid, a branched or unbranched acyl group, a branched or unbranched C8-C30 acyl group, a branched or unbranched alkyl group, and a branched or unbranched C8-C30 alkyl group. In some embodiments, the modified FGF-21 polypeptide described herein may comprise a polypeptide having an amino acid sequence that may contain a non-naturally encoded amino acid that may be linked to an unstructured polypeptide selected from an XTEN or PAS polypeptide. In some embodiments, said half-life extending moiety comprises a poly(ethylene glycol) (PEG) or monomethoxy PEG (mPEG) polymer. In some embodiments, said half-life extending moiety comprises a branched or multiarmed poly(ethylene glycol) (PEG), or other branched or multiarmed water soluble polymer. In some embodiments, said half-life extending moiety comprises a poly(ethylene glycol) (PEG) or monomethoxy PEG (mPEG) moiety having an average molecular weight of between about 0.1 kDa and about 100 kDa. In some embodiments, said half-life extending moiety comprises a poly(ethylene glycol) or monomethoxy PEG (mPEG) moiety having an average molecular weight:
  i) between about 0.1 kDa and about 100 kDa;
  ii) between about 1 kDa and 50 kDa;
  iii) between about 10 kDa and 40 kDa;
  iv) between about 20 kDa and 30 kDa;
  v) between about 0.050 kDa and about 100 kDa; or
  vi) of about 100 kDa, 95 kDa, 90 kDa, 85 kDa, 80 kDa, 75 kDa, 70 kDa, 65 kDa, 60 kDa, 55 kDa, 50 kDa, 45 kDa, 40 kDa, 35 kDa, 30 kDa, 25 kDa, 20 kDa, 15 kDa, 10 kDa, 9 kDa, 8 kDa, 7 kDa, 6 kDa, 5 kDa, 4 kDa, 3 kDa, 2 kDa, 1 kDa, 900 Da, 800 Da, 700 Da, 600 Da, 500 Da, 400 Da, 300 Da, 200 Da, or 100 Da.

In some embodiments, said half-life extending moiety comprises a poly(ethylene glycol) having an average molecular weight of about 30 kDa. In some embodiments, said half-life extending moiety comprises a non-poly(ethylene glycol) water soluble polymer or oligosaccharide.

In some embodiments, said non-naturally encoded amino acid described herein may comprise a carbonyl group, an aminooxy group, a hydrazide group, a hydrazine group, a semicarbazide group, an azide group, or an alkyne group. In some embodiments, said at least one non-naturally encoded amino acid comprises a carbonyl moiety and is linked to a linker, polymer, biologically active molecule, or half-life extending moiety comprising an aminooxy, a hydrazine, a hydrazide or a semicarbazide moiety. In some embodiments, said at least one non-naturally encoded amino acid comprises an aminooxy, hydrazine, hydrazide or semicarbazide moiety which is linked to a linker, polymer, biologically active molecule, or half-life extending moiety through an amide linkage. In some embodiments, said at least one non-naturally encoded amino acid comprises an alkyne moiety which is linked to a linker, polymer, biologically active molecule, or half-life extending moiety via an azide moiety. In some embodiments, said at least one non-naturally encoded amino acid comprises an azide moiety which is linked to a linker, polymer, biologically active molecule, or half-life extending moiety comprising an alkyne moiety. In some embodiments, said at least one non-naturally encoded amino acid comprises an azide or alkyne moiety which is linked to a linker, polymer, biologically active molecule, or half-life extending moiety through an amide linkage. In some embodiments, said at least one non-naturally encoded amino acid is linked to a linker, polymer, biologically active molecule, or half-life extending moiety through an oxime linkage. In some embodiments, said at least one non-naturally encoded amino acid is linked to a linker, polymer, biologically active molecule, or half-life extending moiety through an oxime linkage, wherein said oxime linkage has the structure resulting from the reaction of a carbonyl group and aminooxy group. In some embodiments, said at least one non-naturally encoded amino acid is linked to a linker, polymer, biologically active molecule, or half-life extending moiety through an oxime linkage, wherein said oxime linkage has the structure resulting from the reaction of a carbonyl group contained in said non-naturally encoded amino acid and aminooxy group contained in said linker, polymer, biologically active molecule, or half-life extending moiety.

In some embodiments, the modified FGF-21 polypeptide described herein possesses at least one biological activity of the wild-type human FGF-21 polypeptide having the amino acid sequence of SEQ ID NO:1. In some embodiments, the modified FGF-21 polypeptide described herein possesses at least one of increased thermal stability, reduced aggregation, decreased in vivo proteolysis, decreased deamidation, and increased solubility compared to a FGF-21 polypeptide without said internal deletion or a FGF-21 polypeptide that comprises the amino acid sequence of SEQ ID NO:1 or SEQ ID NO: 201, or compared to the same modified FGF-21 polypeptide without said internal deletion and replacement peptide. In some embodiments, the modified FGF-21 polypeptide described herein possesses at least one of increased thermal stability, reduced aggregation, decreased in vivo proteolysis, decreased deamidation, and increased solubility compared to a pegylated FGF-21 polypeptide without said internal deletion, a non-pegylated FGF-21 polypeptide without said internal deletion, a FGF-21 polypeptide that comprises the amino acid sequence of SEQ ID NO:1, a non-pegylated FGF-21 polypeptide that comprises the amino acid sequence of SEQ ID NO: 201, pegylated SEQ ID NO: 201, or compared to the same modified FGF-21 polypeptide without said internal deletion and replacement peptide.

In some embodiments, the modified FGF-21 polypeptide may be compared to a pegylated FGF-21 polypeptide without said internal deletion. In some embodiments, the modified FGF-21 polypeptide may be compared to a non-pegylated FGF-21 polypeptide without said internal deletion. In some embodiments, the modified FGF-21 polypeptide may be compared to a FGF-21 polypeptide that comprises the amino acid sequence of SEQ ID NO:1. In some embodiments, the modified FGF-21 polypeptide may be compared to SEQ ID NO: 201. In some embodiments, the modified FGF-21 polypeptide may be compared to a pegylated SEQ ID NO: 201. In some embodiments, the modified FGF-21 polypeptide may be compared to the same modified FGF-21 polypeptide without said internal deletion and replacement peptide.

In some embodiments, the modified FGF-21 polypeptide described herein exhibits an increase in transition midpoint (melting temperature, Tm) of between 2° C. and 12° C., between 2° C. and 10° C., between 2° C. and 8° C., between 4° C. and 8° C., between 4° C. and 10° C., between 4° C. and 12° C., or between 6° C. and 8° C. compared to an unmodified FGF-21 polypeptide that comprises the amino acid sequence of SEQ ID NO:1 or SEQ ID NO: 201 or a FGF-21 polypeptide without said internal deletion.

In some embodiments, the modified FGF-21 polypeptide described herein may comprise a polypeptide having an amino acid sequence having at least 85%, 90%, 95%, 96%, 97%, 98%, 99% or 100% identity to the polypeptide of SEQ ID NO: 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 202, 205, 206, 210, 211, 212, 219, 220, 221, 222, or 223. In some embodiments, the modified FGF-21 polypeptide described herein may comprise a polypeptide having an amino acid sequence having at least 95% identity to the polypeptide of SEQ ID NO: 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 202, 205, 206, 210, 211, 212, 219, 220, 221, 222, or 223. In some embodiments, the modified FGF-21 polypeptide described herein may comprise a polypeptide having an amino acid sequence having at least 98% identity to the polypeptide of SEQ ID NO: 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 202, 205, 206, 210, 211, 212, 219, 220, 221, 222, or 223. In some embodiments, the modified FGF-21 polypeptide described herein may comprise a polypeptide having an amino acid sequence having at least 85%, 90%, 95%, 96%, 97%, 98%, 99% or 100% identity to the polypeptide of SEQ ID NO: 102 or SEQ ID NO: 202. In some embodiments, the modified FGF-21 polypeptide described herein may comprise a polypeptide having an amino acid sequence having at least 95% identity to the polypeptide of SEQ ID NO: 102 or SEQ ID NO: 202. In some embodiments, the modified FGF-21 polypeptide described herein may comprise a polypeptide having an amino acid sequence having at least 98% identity to the polypeptide of SEQ ID NO: 102 or SEQ ID NO: 202. In some embodiments, the modified FGF-21 polypeptide described herein may comprise a polypeptide having an amino acid sequence of SEQ ID NO: 202. In some embodiments, the modified FGF-21 polypeptide described herein may comprise a polypeptide having an amino acid sequence of SEQ ID NO: 202, wherein pAF in SEQ ID NO:202 may be linked to a poly(ethylene glycol). In some embodiments, the poly(ethylene glycol) may have an average molecular weight of about 30 kDa.

In some embodiments, the modified FGF-21 polypeptide described herein may comprise a polypeptide having an N-terminal methionine (which may be present after expression in some systems, such as E. coli). In some embodiments, the modified FGF-21 polypeptide described herein may comprise a polypeptide having no N-terminal methionine, for example as a result of processing to remove a signal peptide containing an N-terminal methionine, e.g. in a mammalian cell-based expression system. In some embodiments, the modified FGF-21 polypeptide may include any of the sequences or variants thereof disclosed herein but omitting an N-terminal methionine, e.g., any one of SEQ ID NOs:101-132, 201-202, 205-206, 210-212, 219-223, or any one of the variant, modified, or fusion forms thereof described herein, with the N-terminal methionine omitted or absent. In some embodiments, the modified FGF-21 polypeptide may include any of the sequences or variants thereof disclosed herein, e.g., any one of SEQ ID NOs:401-487 or any one of the variant, modified, or fusion forms thereof described herein, with an N-terminal methionine added or present. In some embodiments, the modified FGF-21 polypeptide described herein may comprise a polypeptide having an amino acid sequence of SEQ ID NO: 202 without the N-terminal methionine. In some embodiments, the modified FGF-21 polypeptide described herein may comprise a polypeptide having an amino acid sequence of SEQ ID NO: 202 (optionally without the N-terminal methionine), wherein the pAF in SEQ ID NO:202 is linked to a poly(ethylene glycol) having an average molecular weight of about 30 kDa.

In some embodiments, the modified FGF-21 polypeptide described herein may comprise a polypeptide having an amino acid sequence of SEQ ID NO: 102. In some embodiments, the modified FGF-21 polypeptide described herein may comprise a polypeptide having an amino acid sequence of SEQ ID NO: 102 without the N-terminal methionine. In some embodiments, the modified FGF-21 polypeptide described herein may comprise a polypeptide having an amino acid sequence of SEQ ID NO: 102 without the N-terminal methionine and a Fc domain or fragment thereof. In some embodiments, the modified FGF-21 polypeptide described herein may comprise a polypeptide having an amino acid sequence of SEQ ID NO: 102 and a Fc domain or fragment thereof. In some embodiments, the modified FGF-21 polypeptide described herein may comprise SEQ ID NO:475.

In some embodiments the disclosure provides an isolated nucleic acid encoding a modified FGF-21 polypeptide described herein. In some embodiments, provided herein is an expression vector comprising an isolated nucleic acid encoding a modified FGF-21 polypeptide described herein. In some embodiments, provided herein is a host cell comprising an expression vector comprising an isolated nucleic acid encoding a modified FGF-21 polypeptide described herein. In some embodiments, the host cell is a mammalian cell, such as CHO or HEK. In some embodiments, the host cell is a bacterium, such as *E. coli*. In some embodiments, the host cell is a yeast, such as *Saccharomyces cerevisiae*. In some embodiments the disclosure provides a method of producing a modified FGF-21 polypeptide, comprising culturing the host cell described herein and isolating said modified FGF-21 polypeptide. In some embodiments the disclosure provides a method of producing a modified FGF-21 polypeptide comprising a non-naturally encoded amino acid. In some embodiments, the non-naturally encoded amino acid is encoded by a selector codon. In some embodiments, the method comprises culturing a host cell described herein wherein said host cell comprises an orthogonal tRNA that recognizes said selector codon and introduces said non-naturally encoded amino acid into said modified FGF-21 polypeptide, and isolating said modified FGF-21 polypeptide.

In some embodiments the disclosure provides a composition comprising the modified FGF-21 polypeptide described herein and a pharmaceutically acceptable carrier or excipient. In some embodiments the disclosure provides a composition comprising a modified FGF-21 polypeptide comprising a polypeptide having an amino acid sequence of SEQ ID NO: 202, wherein pAF in SEQ ID NO:202 may be linked to a poly(ethylene glycol), and a pharmaceutically acceptable carrier or excipient. In some embodiments the poly(ethylene glycol) has an average molecular weight of about 30 kDa.

In some embodiments, the disclosure provides a composition comprising a modified FGF-21 polypeptide comprising a polypeptide having an amino acid sequence of SEQ ID NO: 102 without the N-terminal methionine, fused to a Fc domain or fragment thereof, and a pharmaceutically acceptable carrier or excipient. In some embodiments, the disclosure provides a composition comprising a modified FGF-21 polypeptide comprising SEQ ID NO:475 and a pharmaceutically acceptable carrier or excipient.

In some embodiments the disclosure provides a composition comprising the modified FGF 21 polypeptide described herein and a pharmaceutically acceptable carrier or excipient and at least one other active agent. In some embodiments, the at least one other active agent is an anti-diabetes agent, cholesterol controlling agent, anti-inflammatory agent, anti-obesity agent, an antihypertensive agent, or an anti-fibrosis agent. In some embodiments, the at least one other active agent is a GLP-1 agonist or an insulin. In some embodiments, the at least one other active agent is a rapid acting, short acting, regular acting, intermediate acting, or long acting insulin, HUMALOG® (insulin lisper), Lisper, NOVOLOG® (insulin apart), APIDRA® Insulin guising, HUMULIN® (insulin ecophene and insulin), apart, human insulin, NPH, lento, untalented, LANTUS® (insulin glaring), glaring, LEVEMIR® (insulin deemed), deemed; eventide (BYETTA® (eventide)/BYDUREON® (eventide extended-release)), liraglutide (VICTOZA®), lixisenatide (LYXUMIA®), albiglutide (TANZEUM®), exenatide long-acting release (LAR), taspoglutide, albiglutide, LY2189265 (dulaglutide); orlistat, (XENICAL®), a pancreatic lipase inhibitor, naltrexone, phentermine, topiramate, (OSYMIA®), lorcaserin, (BELVIQ®), naltrexone and bupropion, (CONTRAVE®), rimonabant, (ACOMPLIA®), a cannabinoid receptor antagonist, sibutramine, (MERIDIA®), lorcaserin, rimonabant, pramlintide, phentermine, topiramate, bupropion, or glucomannan.

In some embodiments the disclosure provides a method of regulating at least one of glucose and lipid homeostasis, glucose uptake, GLUT 1 expression, and/or serum concentrations of glucose, triglycerides, insulin or glucagon in a patient in need thereof, comprising administering to the patient a therapeutically effective amount of a modified FGF-21 polypeptide disclosed herein or a composition disclosed herein. In some embodiments the disclosure provides a method of increasing insulin sensitivity, increasing levels of adiponectin, reducing levels of blood glucose, reducing levels of glucagon, reducing levels of triglyceride, reducing levels of fructosamine, reducing levels of low density cholesterol, or reducing levels of C-reactive protein in a patient in need thereof, comprising administering to the patient a therapeutically effective amount of a modified FGF-21 polypeptide disclosed herein or a composition disclosed herein. In some embodiments the disclosure provides a method of treating a condition or disorder selected from obesity, diabetes, pancreatitis, insulin resistance, hyperinsulinemia, glucose intolerance, hyperglycemia, metabolic syndrome, impaired glucose tolerance, inadequate glucose clearance, high blood glucose, and Prader-Willi syndrome in a patient in need thereof, comprising administering to the patient a therapeutically effective amount of a modified FGF-21 polypeptide disclosed herein or a composition disclosed herein. In some embodiments the disclosure provides a method of treating an insulin related condition or disorder selected from Type A Insulin Resistance, Type C Insulin Resistance (AKA HAIR-AN Syndrome), Rabson-Mendenhall Syndrome, Donohue's Syndrome or Leprechaunism, hyperandrogenism, hirsuitism, or acanthosis nigricans in a patient in need thereof, comprising administering to the patient a therapeutically effective amount of a modified FGF-21 polypeptide disclosed herein or a composition disclosed herein. In some embodiments the disclosure provides a method of treating type 1 diabetes or type 2 diabetes in a patient in need thereof, comprising administering to the patient a therapeutically effective amount of a modified FGF-21 polypeptide disclosed herein or a composition disclosed herein. In some embodiments the disclosure provides a method of treating obesity in a patient in need thereof, comprising administering to the patient a therapeutically effective amount of a modified FGF-21 polypeptide disclosed herein or a composition disclosed herein.

In another embodiment, the present disclosure provides a method of treating a disease associated with fibrosis comprising administering to a patient in need thereof an effective amount of a modified FGF-21 polypeptide or a composition comprising a modified FGF-21 polypeptide as described herein. In some embodiments, the disease associated with fibrosis may affect an organ or tissue such as the pancreas, lung, heart, kidney, liver, eyes, nervous system, bone marrow, lymph nodes, endomyocardium, and/or retroperitoneum. In some embodiments, the disease associated with fibrosis may be liver fibrosis or pre-cirrhosis. In some embodiments, the disease associated with fibrosis may be selected from: nonalcoholic steatohepatitis (NASH), cirrhosis, diffuse parenchymal lung disease, cystic fibrosis, pulmonary fibrosis, progressive massive fibrosis, idiopathic pulmonary fibrosis, injection fibrosis, renal fibrosis, chronic kidney disease, diabetic kidney disease, focal segmental glomerulosclerosis, membranous nephropathy, IgA nephropathy, myelofibrosis, heart failure, metabolic heart failure, cardiac fibrosis, cataract fibrosis, cataract, ocular scarring, pancreatic fibrosis, skin fibrosis, intestinal fibrosis, intestinal strictures, endomyocardial fibrosis, atrial fibrosis, mediastinal fibrosis, Crohn's disease, retroperitoneal fibrosis, keloid, nephrogenic systemic fibrosis, scleroderma, systemic sclerosis, arthrofibrosis, Peyronie's syndrome, Dupuytren's contracture, diabetic neuropathy, adhesive capsulitis, alcoholic liver disease, hepatosteatosis, viral hepatitis, biliary disease, primary hemochromatosis, drug-related cirrhosis, cryptogenic cirrhosis, Wilson's disease, and, alpha 1-antitrypsin deficiency, interstitial lung disease (ILD), human fibrotic lung disease, liver fibrosis, macular degeneration, retinal retinopathy, vitreal retinopathy, myocardial fibrosis, Grave's ophthalmopathy, drug induced ergotism, cardiovascular disease, atherosclerosis/restenosis, hypertrophic scars, primary or idiopathic myelofibrosis, and inflammatory bowel disease (including, but not limited to, collagenous colitis). In some embodiments, the disease associated with fibrosis results from one or more of pulmonary disease, lung cancer, drug therapy, chemotherapy, or radiation therapy. In some embodiments, the disease associated with fibrosis results from one or more of aging, heart attack, stroke, myocardial damage, or left ventricular dysfunction. In some embodiments, the disease associated with fibrosis may be selected from renal fibrosis, glomerular nephritis, chronic kidney disease, chronic kidney failure, and nephritis associated with systemic lupus, cancer, physical obstructions, toxins, metabolic disease, immunological diseases, or diabetic nephropathy. In some embodiments, the disease associated with fibrosis results from one or more of trauma, spinal injury, infection, surgery, ischemic injury, heart attack, burns, environmental pollutant exposure, pneumonia, tuberculosis, or acute respiratory distress syndrome. In some embodiments, the disease associated with fibrosis may be selected from pulmonary fibrosis, interstitial lung disease, human fibrotic lung disease, idiopathic pulmonary fibrosis, liver fibrosis, cardiac fibrosis, myocardial fibrosis, macular degeneration, retinal retinopathy, vitreal retinopathy, Grave's ophthalmopathy, drug induced ergotism, cardiovascular disease, atherosclerosis/restenosis, keloids and hypertrophic scars, primary or idiopathic myelofibrosis, inflammatory bowel disease, collagenous colitis, ocular scarring and cataract fibrosis. In some embodiments, the disease associated with fibrosis may be selected from NASH, liver fibrosis, and cirrhosis. In some embodiments, the disease associated with fibrosis may be NASH. In some embodiments, the disease associated with fibrosis may be selected from diabetic kidney disease, chronic kidney disease, and renal fibrosis. In some embodiments, the disease associated with fibrosis may be selected from metabolic heart failure and cardiac fibrosis. In some embodiments, the disease associated with fibrosis may be lung fibrosis.

In some embodiments, the present disclosure provides a method of treating liver fibrosis or cirrhosis in a patient in need thereof, comprising administering to the patient an effective amount of a modified FGF-21 polypeptide described herein or a composition described herein. In some embodiments, the present disclosure provides a method of treating or preventing NASH in a patient in need thereof, comprising administering to the patient an effective amount of a modified FGF-21 polypeptide described herein or a composition described herein.

In some embodiments, the present disclosure provides a method of decreasing the hepatic fat fraction in a patient in need thereof, comprising administering to the patient an effective amount of a modified FGF-21 polypeptide described herein or a composition described herein, wherein optionally said patient is at risk of developing or has been diagnosed with NASH. In some embodiments, the present disclosure provides a method of decreasing liver stiffness, decreasing percentage body fat, decreasing body weight, decreasing liver-to-body weight ratio, decreasing liver lipid content, decreasing liver fibrosis area, decreasing fasting blood glucose levels, fasting triglyceride, decreasing LDL cholesterol, decreasing ApoB, decreasing ApoC, and/or increasing HDL cholesterol in a patient in need thereof, comprising administering to the patient an effective amount of a modified FGF-21 polypeptide described herein or a composition described herein, wherein optionally said patient is at risk of developing or has been diagnosed with NASH. In some embodiments, the present disclosure provides a method of increasing adiponectin levels in a patient in need thereof, comprising administering to the patient an effective amount of a modified FGF-21 polypeptide described herein or a composition described herein, wherein optionally said patient is at risk of developing or has been diagnosed with NASH. In some embodiments, the present disclosure provides a method of treating one or more symptoms associated with NASH in a patient in need thereof, comprising administering to the patient an effective amount of a modified FGF-21 polypeptide described herein or a composition described herein.

Provided herein are methods of treating or preventing NASH in a patient in need thereof, comprising administering to the patient a therapeutically effective amount of a modified FGF-21 polypeptide comprising a polypeptide having an amino acid sequence at least 85%, 90%, 95%, 96%, 97%, 98%, 99% or 100% identical to SEQ ID NO: 202. In some embodiments, the modified FGF-21 polypeptide comprises a polypeptide having an amino acid sequence at least 95% identical to SEQ ID NO: 202. Provided herein are also methods of treating or preventing NASH in a patient in need thereof, comprising administering to the patient a therapeutically effective amount of a modified FGF-21 polypeptide comprising SEQ ID NO: 202, wherein the pAF residue thereof is linked to a poly(ethylene glycol) moiety. In some embodiments, said poly(ethylene glycol) has a molecular weight of between about 0.1 kDa and 100 kDa, or between about 20 kDa and about 40 kDa, or of about 30 kDa. In some embodiments, said poly(ethylene glycol) has a molecular weight of about 30 kDa.

Provided herein are methods of treating or preventing NASH in a patient in need thereof, comprising administering to the patient a therapeutically effective amount of a modified FGF-21 polypeptide comprising a polypeptide having an amino acid sequence at least 85%, 90%, 95%, 96%, 97%, 98%, 99% or 100% identical to SEQ ID NO:102. In some embodiments, the modified FGF-21 polypeptide comprises a polypeptide having an amino acid sequence at least 95% identical to SEQ ID NO: 102. Provided herein are also methods of treating or preventing NASH in a patient in need thereof, comprising administering to the patient a therapeutically effective amount of a modified FGF-21 polypeptide comprising (a) SEQ ID NO:102 without the N-terminal Met, or (b) SEQ ID NO:102.

Provided herein are methods of treating or preventing NASH in a patient in need thereof, comprising administering to the patient a therapeutically effective amount of a modified FGF-21 polypeptide comprising a polypeptide having an amino acid sequence at least 85%, 90%, 95%, 96%, 97%, 98%, 99% or 100% identical to SEQ ID NO: 475. In some embodiments, the modified FGF-21 polypeptide comprises a polypeptide having an amino acid sequence at least 95% identical to SEQ ID NO: 475. Provided herein are methods of treating or preventing NASH in a patient in need thereof, comprising administering to a patient in need thereof a therapeutically effective amount of a modified FGF-21 polypeptide comprising SEQ ID NO: 475.

In some embodiments, the patient may exhibit NASH CRN fibrosis stage 1-3, which optionally is determined by a liver biopsy. In some embodiments, prior to treatment the patient may exhibit a fatty liver index of at least about 60. In some embodiments, prior to treatment the patient may exhibit a hepatic fat fraction percentage of at least 10%, which optionally is determined by magnetic resonance imaging.

In some embodiments, the present disclosure provides a method of treating heart failure or cardiac fibrosis in a patient in need thereof, comprising administering to the patient an effective amount of a modified FGF-21 polypeptide described herein or a composition described herein. In some embodiments, the present disclosure provides a method of treating kidney or renal fibrosis in a patient in need thereof, comprising administering to the patient an effective amount of a modified FGF-21 polypeptide described herein or a composition described herein. In some embodiments, the present disclosure provides a method of treating lung fibrosis in a patient in need thereof, comprising administering to the patient an effective amount of a modified FGF-21 polypeptide described herein or a composition described herein.

In some embodiments the present disclosure provides methods of treating a disease associated with fibrosis in a patient in need thereof, comprising administering to the patient an effective amount of a modified FGF-21 polypeptide comprising one or more non-naturally encoded amino acids, wherein said modified FGF-21 polypeptide possesses at least 90% or 95% identity to a human FGF-21 polypeptide having an amino acid sequence selected from SEQ ID NOs:1-7 and 201, wherein said disease associated with fibrosis is selected from NASH, liver fibrosis, diabetic kidney disease, chronic kidney disease, renal fibrosis, lung fibrosis, cardiac fibrosis, heart failure, and metabolic heart failure.

In some embodiments, the modified FGF-21 polypeptide possesses at least 96%, 97%, 98% or 99% identity to a human FGF-21 polypeptide having an amino acid sequence selected from SEQ ID NOs:1-7 and 201.

In some embodiments the present disclosure provides a method of treating a disease associated with fibrosis comprising administering to a patient in need thereof an effective amount of the modified FGF-21 polypeptide of SEQ ID NO:201, optionally linked to a polymer or water soluble polymer which may comprise poly(ethylene glycol), optionally having a molecular weight of between 1 and 100 kDa or about 30 kDa, wherein said disease associated with fibrosis may be selected from NASH, liver fibrosis, diabetic kidney disease, chronic kidney disease and metabolic heart failure.

In some embodiments, the at least one non-naturally encoded amino acid may be at a position corresponding to amino acid 72, 77, 86, 87, 91, 108, 110, 126, 131, or 146 of SEQ ID NO: 1. In some embodiments, the at least one non-naturally encoded amino acid may be at a position corresponding to amino acid 108 in SEQ ID NO: 1. In some embodiments, the at least one non-naturally encoded amino acid may be at a position corresponding to amino acid 77, 91, or 131 in SEQ ID NO:1.

In some embodiments, the non-naturally encoded amino acid may comprise a phenylalanine analog or derivative. In some embodiments, the non-naturally encoded amino acid may comprise para-acetyl-L-phenylalanine. In some embodiments, the non-naturally encoded amino acid may comprise para-acetyl-L-phenylalanine and may be at a position corresponding to amino acid 108 in SEQ ID NO: 1.

In some embodiments, the at least one non-naturally encoded amino acid may be linked to a poly(ethylene glycol) (PEG) or monomethoxy PEG (mPEG) moiety having an average molecular weight of between about 0.1 kDa and about 100 kDa. In some embodiments, the at least one non-naturally encoded amino acid may be linked to a poly(ethylene glycol) or monomethoxy PEG (mPEG) moiety having an average molecular weight: i) between about 0.1 kDa and about 100 kDa; ii) between about 1 kDa and 50 kDa; iii) between about 10 kDa and 40 kDa; iv) between about 20 kDa and 30 kDa; v) between about 0.050 kDa and about 100 kDa; or vi) of about 100 kDa, 95 kDa, 90 kDa, 85 kDa, 80 kDa, 75 kDa, 70 kDa, 65 kDa, 60 kDa, 55 kDa, 50 kDa, 45 kDa, 40 kDa, 35 kDa, 30 kDa, 25 kDa, 20 kDa, 15 kDa, 10 kDa, 9 kDa, 8 kDa, 7 kDa, 6 kDa, 5 kDa, 4 kDa, 3 kDa, 2 kDa, 1 kDa, 900 Da, 800 Da, 700 Da, 600 Da, 500 Da, 400 Da, 300 Da, 200 Da, or 100 Da. In some embodiments, the at least one non-naturally encoded amino acid may be linked to a poly(ethylene glycol) having an average molecular weight of about 30 kDa.

In some embodiments, the at least one non-naturally encoded amino acid may be linked to a linker, polymer, biologically active molecule, or half-life extending moiety through an oxime linkage. In some embodiments, the oxime linkage has the structure resulting from the reaction of a carbonyl group and aminooxy group.

In some embodiments, the modified FGF 21 polypeptide may possess at least one biological activity of the wild-type human FGF 21 polypeptide having the amino acid sequence of SEQ ID NO:1 or of another FGF-21 polypeptide.

In some embodiments, the method may further comprise administration of at least one other active agent to said patient, wherein said additional active agent may be contained in the same composition as said modified FGF-21 polypeptide or may be administrated separately. In some embodiments, the at least one other active agent may be selected from anti-fibrotic agents, N-cadherin antagonist, anti-N cadherin antibody, small molecule N-cadherin antagonist, antagonistic N-cadherin fragment, anti-inflammatory agents, hepatoprotective agents suppressing renin-angiotensin system (RAS) system, probiotics, and polyunsaturated fatty acids (PUFAs). In some embodiments, the anti-fibrotic agent may be selected from nintedanib, pirfenidone, LPA1 antagonists, LPA1 receptor antagonists, GLP1 analog, tralokinumab (IL-13, AstraZeneca), vismodegib (hedgehog antagonist, Roche), PRM-151 (pentraxin-2, TGF beta-1, Promedior), SAR-156597 (bispecific Mab IL-4&IL-13, Sanofi), simtuzumab (anti-lysyl oxidase-like 2 (anti-LOXL2) antibody, Gilead), CKD-942, PTL-202 (PDE inh./pentoxifylline/NAC oral control. release, Pacific Ther.), omipalisib (oral PI3K/mTOR inhibitor, GSK), IW-001 (oral sol. bovine type V collagen mod., ImmuneWorks), STX-100 (integrin alpha V/beta-6 ant, Stromedix/Biogen), ACTIMMUNE® (IFN gamma), PC-SOD (midismase; inhaled, LTT Bio-Pharma/CKD Pharm), lebrikizumab (anti-IL-13 SC humanized mAb, Roche), AQX-1125 (SHIP1 activator, Aquinox), CC-539 (JNK inhibitor, Celgene), FG-3019 (FibroGen), and SAR-100842 (Sanofi). In some embodiments, the hepatoprotective agent may be ursodeoxycholic acid (UDCA) or obeticholic acid (OCA or INT-747, Intercept).

In some embodiments, the present disclosure provides a composition comprising a modified FGF-21 polypeptide adapted for use in the method of treating a disease associated with fibrosis as described herein and a pharmaceutically acceptable carrier or excipient. In some embodiments, the composition may further comprise at least one other active agent. In some embodiments, the at least one other active agent may be selected from anti-fibrotic agents, pirfenidone, N-cadherin antagonist, anti-N cadherin antibody, small molecule N-cadherin antagonist, antagonistic N-cadherin fragment, anti-inflammatory agents, hepatoprotective agents such as ursodeoxycholic acid (UDCA), obeticholic acid (OCA or INT-747, Intercept), suppressing renin-angiotensin system (RAS) system, probiotics and polyunsaturated fatty acids (PUFAs).

In some embodiments the present disclosure provides a method of treating medically complicated obesity comprising administering to a patient in need thereof an effective amount of a modified FGF-21 polypeptide according as described herein or a composition comprising a modified FGF-21 polypeptide as described herein. In some embodiments the medically complicated obesity may be associated with Prader-Willi Syndrome.

In some embodiments, the modified FGF-21 polypeptide disclosed herein or composition comprising a modified FGF-21 polypeptide disclosed herein and a pharmaceutically acceptable carrier or excipient may be administered orally, topically, or via injection. In some embodiments, the modified FGF-21 polypeptide or composition may be administered via subcutaneous injection, IV injection, intraperitoneal injection, intramuscular injection.

In some embodiments, the modified FGF-21 polypeptide or composition disclosed herein is administered at a frequency of about once per day, or less frequently than about once per day. In some embodiments, the modified FGF-21 polypeptide or composition disclosed herein is administered at a frequency of about twice per week, or less frequently than about twice per week. In some embodiments, the modified FGF-21 polypeptide or composition disclosed herein is administered at a frequency of about once per week, or less frequently than about twice per week. In some embodiments, the modified FGF-21 polypeptide or composition disclosed herein is administered at a frequency of about once per two weeks, or less frequently than about twice per week. In some embodiments, the modified FGF-21 polypeptide or composition disclosed herein is administered at a frequency of about once per three weeks, or less frequently than about twice per week. In some embodiments, the modified FGF-21 polypeptide or composition disclosed herein is administered at a frequency of about once per month, or less frequently than about once per month. In some embodiments, the modified FGF-21 polypeptide or composition disclosed herein is administered at a frequency of once per four weeks. In some embodiments, the modified FGF-21 polypeptide or composition disclosed herein is administered at a frequency of about once per day. In some embodiments, the modified FGF-21 polypeptide or composition disclosed herein is administered at a frequency of about once per week.

In some embodiments, the modified FGF-21 polypeptide disclosed herein may be administered in an amount between about 0.01 mg and about 500 mg per dose, between about 0.1 mg and about 200 mg per dose, between about 0.2 mg and about 100 mg per dose, between about 0.5 mg and about 80 mg per dose, between about 1 mg and about 60 mg per dose, between about 5 mg and about 40 mg per dose, between about 10 mg and about 30 mg per dose, between about 10 mg and about 20 mg per dose, between about 0.2 mg and about 1 mg per dose, between about 1 mg and about 2 mg per dose, between about 2 mg and about 4 mg per dose, between about 4 mg and about 6 mg per dose, between about 6 mg and about 10 mg per dose, between about 10 mg and about 20 mg per dose, between about 20 mg and about 40 mg per dose, between about 40 mg and about 60 mg per dose, between about 60 mg and about 80 mg per dose, between about 80 mg and about 100 mg per dose, between about 100 mg and about 120 mg per dose, between about 120 mg and about 140 mg per dose, between about 140 mg and about 160 mg per dose, between about 160 mg and about 180 mg per dose, between about 180 mg and about 200 mg per dose, or between about 200 mg and about 240 mg per dose.

In some embodiments, the modified FGF-21 polypeptide disclosed herein may be administered in an amount selected from about 0.2 mg, about 0.6 mg, about 1 mg, about 2 mg, about 4 mg, about 6 mg, about 8 mg, about 10 mg, about 20 mg, about 40 mg, about 60 mg, about 80 mg, about 100 mg, about 120 mg, about 140 mg, about 160 mg, about 180 mg, and about 200 mg per dose. In some embodiments, the modified FGF-21 polypeptide disclosed herein may be administered in an amount selected from about 0.2 mg, about 0.6 mg, about 2 mg, about 6 mg, about 20 mg, about 40 mg, and about 60 mg per dose.

In some embodiments, the modified FGF-21 polypeptide or composition comprising a modified FGF-21 polypeptide disclosed herein and a pharmaceutically acceptable carrier or excipient may be co-administered, or administered separately (concurrently or sequentially) with at least one other active agent. In some embodiments, the at least one other active agent is selected from anti-diabetes agents, anti-obesity agents, cholesterol controlling agents, anti-inflammatory agents, and antihypertensive agents.

In some embodiments, the at least one other active agent is selected from a statin, a GLP-1 agonist, and insulin. In some embodiments, the at least one other active agent is selected from amylin, amylin analog, alpha-glucosidase inhibitor such as miglitol, acarbose, voglibose, metformin, biguanide, a glitazone such as rosiglitazone, pioglitazone, troglitazone, a secretagogue such as exenatide, liraglutide, taspoglutide or lixisenatide, a glycosuric, a dipeptidyl peptidase-4 inhibitor, insulin, a rapid acting, short acting, regular acting, intermediate acting, or long acting insulin, HUMALOG® (insulin lispro), Lispro, NOVOLOG® (insulin aspart), APIDRA® Insulin glulisine, HUMULIN® (insulin isophane and insulin), aspart, human insulin, NPH, lente, ultralente, LANTUS® (insulin glargine), glargine, LEVEMIR® (insulin detemir), detemir, atorvastatin, cerivastatin, fluvastatin, lovastatin, mevastatin, pitavastatin, pravastatin, rosuvastatin, simvastatin, VYTORIN® (ezetimibe and simvastatin), ADVICOR (niacin and lovastatin), CADUET® (amlodipine besylate/atorvastatin calcium), SIMCOR® (Niacin / Simvastatin), orlistat (XENICAL®), a pancreatic lipase inhibitor, naltrexone, phentermine and topiramate (OSYMIA®), lorcaserin, (BELVIQ®), naltrexone and bupropion (CONTRAVE®), rimonabant, (ACOMPLIA®), a cannabinoid receptor antagonist, sibutramine, (MERIDIA®), lorcaserin, rimonabant, exenatide, pramlintide, phentermine, topiramate, a mood stabilizer, bupropion, glucomannan, guar gum, DEXEDRINE® (dextroamphetamine), digoxin, an anorectic drug, an anti-obesity drug, exenatide (BYETTA® (exenatide)/BYDUREON® (exenatide extended-release)), liraglutide (VICTOZA®), lixisenatide (LYXUMIA®), albiglutide (TANZEUM®), exenatide long-acting release (LAR), taspoglutide, albiglutide, and LY2189265 (dulaglutide).

Advantageously, modified FGF-21 compounds described herein may increase efficacy by allowing for a longer circulating half-life requiring fewer doses, increasing both the convenience to a subject in need of such therapy and the likelihood of a subject's compliance with dosing requirements.

Metabolic syndrome is typically diagnosed in patients exhibiting at least three of the following signs: abdominal fat—in most men, a 40-inch waist or greater; high blood sugar—at least 110 milligrams per deciliter (mg/dL) after fasting; high triglycerides—at least 150 mg/dL in the bloodstream; low HDL—less than 40 mg/dL; and, blood pressure of 130/85 or higher.

The subject methods may be effective to treat or delay the onset of type II diabetes and/or obesity in a patient in need thereof. Said patient may have been diagnosed with pre-diabetes or may exhibit one or more risk factors for development of type II diabetes, such as a family history of type II diabetes; one or more parents or siblings previously diagnosed with type II diabetes; dyslipidemia; total blood triglyceride levels of at least 200 mg/dL; blood high density lipoprotein level less than 35 mg/dL; obesity; body mass index greater than 25 kg/m2; history of gestational diabetes; previously gave birth to an infant with birth weight greater than 9 lbs.; hypertension; systolic blood pressure of at least 140 mmHg; diastolic blood pressure of at least 90 mmHg; previous measurement of fasting blood glucose of at least 99 mg/dL; vascular disease; Polycystic Ovarian Syndrome; or acanthosis nigricans.

The patient may exhibit one or more symptoms of pre-diabetes such as fasting blood glucose level of between 100 mg/dL and 125 mg/dl; blood sugar level of between 140 mg/dL and 199 mg/dL two hours after ingesting a 75 gram glucose solution or a glucose solution of 1.75 grams of glucose per kilogram of body weight, to a maximum dose of 75 grams; and/or glycated hemoglobin of between 5.7 percent and 6.4 percent.

The patient may exhibit one or more symptoms of diabetes, such as fasting blood glucose level greater than 125 mg/dl; blood sugar level of at least 200 mg/dL two hours after ingesting a 75 gram glucose solution or a glucose solution of 1.75 grams of glucose per kilogram of body weight, to a maximum dose of 75 grams; and/or glycated hemoglobin of at least 6.5 percent.

The patient may have been diagnosed with type II diabetes.

The patient may be refractory to treatment with at least one compound selected from the group consisting of: GLP-1, exenatide-1, exendin, exendin analog, exendin agonist, liraglutide, lixisenatide, albiglutide, exenatide LAR, a DPP-4 inhibitor, a GLP-1 receptor agonist, and another GLP-1 agonist; or such compound may be contraindicated for administration to the patient.

The methods may further comprise administering to said patient an anti-diabetic agent or anti-obesity agent in addition to said modified FGF-21 polypeptide. Said anti-diabetic agent or anti-obesity agent may comprise one or more of amylin, amylin agonist, sulfonylureas, calcitonin, glucagon, PPAR-gamma agonists, GPL-1 receptor agonists, dipeptidyl peptidase IV inhibitor, amylin analogs, biguanides, dopamine D2 receptor agonists, meglitinides, alpha-glucosidase inhibitor, antidyslipidemic bile acid sequestrant, exendin, exendin analog, exendin agonist, gastric inhibitory peptide (GIP), incretin peptide, insulin, SGLT2 inhibitor, a glucose reabsorption inhibitor, fenofibrate, fibrate, an anti-ghrelin antibody or antibody fragment, an fibroblast growth factor receptor (FGFR)-1(IIIb), FGFR-1(IIIc), antibody or antibody fragment, and/or FGFR-4(IIIc), an anti-CD38 antibody or antibody fragment, an anti-MIC-1 antibody, or MIC-1 binding fragment, metformin or a combination of any of the foregoing.

In an exemplary embodiment, said anti-diabetic agent may be metformin, insulin glargine such as, LANTUS® (Sanofi), sitagliptin such as JANUVIA®, insulin aspart such as NOVOLOG® (insulin aspart) and NOVORAPID® (insulin aspart) (Novo Nordisk), insulin lispro such as HUMALOG® (Eli Lilly), liraglutide such as VICTOZA® (Novo Nordisk), insulin detemir such as LEVEMIR® (Novo Nordisk), sitagliptin in combination with metformin such as JANUMET® (Merck), soluble insulin aspart and protamine-crystallised insulin aspart in the ratio 30/70 such as NOVOMIX 30® (Novo Nordisk), or pioglitazone such as ACTOS® (Takeda).

The method may be effective to cause weight loss.

The antidiabetic agents used in the combination with the modified FGF-21 polypeptides of the present invention include, but are not limited to, insulin secretagogues or insulin sensitizers, MGAT2 inhibitors, or other antidiabetic agents. These agents include, but are not limited to, dipeptidyl peptidase IV (DP4) inhibitors (for example, sitagliptin, saxagliptin, alogliptin, vildagliptin and the like), biguanides (for example, metformin, phenformin and the like), sulfonyl ureas (for example, glyburide, glimepiride, glipizide and the like), glucosidase inhibitors (for example, acarbose, miglitol, and the like), PPARγ agonists such as thiazolidinediones (for example, rosiglitazone, pioglitazone, and the like), PPAR oily dual agonists (for example, muraglitazar, tesaglitazar, aleglitazar, and the like), glucokinase activators (as described in Fyfe, M. C. T. et al., *Drugs of the Future*, 34(8):641-653 (2009) and incorporated herein by reference), GPR40 receptor modulators, GPR119 receptor modulators (MBX-2952, PSN821, APD597 and the like), SGLT2 inhibitors (dapagliflozin, canagliflozin, remagliflozin and the like), amylin analogs such as pramlintide, and/or insulin. The modified FGF-21 polypeptides of the present invention may also be optionally employed in combination with agents for treating complication of diabetes. These agents include PKC inhibitors and/or AGE inhibitors.

The modified FGF-21 polypeptides of the present invention may also be optionally employed in combination with one or more hypophagic agents such as diethylpropion, phendimetrazine, phentermine, orlistat, sibutramine, lorcaserin, pramlintide, topiramate, MCHR1 receptor antagonists, oxyntomodulin, naltrexone, Amylin peptide, NPY Y5 receptor modulators, NPY Y2 receptor modulators, NPY Y4 receptor modulators, cetilistat, 5HT2c receptor modulators, and the like. The modified FGF-21 polypeptides may also be employed in combination with an agonist of the glucagon-like peptide-1 receptor (GLP-1R), such as exenatide, liraglutide, GPR-1(1-36) amide, GLP-1(7-36) amide, GLP-1(7-37) (as disclosed in U.S. Pat. No. 5,614,492 to Habener, the disclosure of which is incorporated herein by reference), which may be administered via injection, intranasal, or by transdermal or buccal devices.

The modified FGF-21 polypeptides of the present invention may also be optionally employed in combination with one or more other types of therapeutic agents, such as DGAT inhibitors, LDL lowering drugs such as statins (inhibitors of HMG CoA reductase) or inhibitors of cholesterol absorption, modulators of PCSK9, drugs increase HDL such as CETP inhibitors.

In some embodiments, the non-naturally encoded amino acid may be linked to a water soluble polymer. In some embodiments, the water soluble polymer comprises a poly(ethylene glycol) moiety. In some embodiments, the non-naturally encoded amino acid is linked to the water soluble polymer with a linker or is bonded to the water soluble polymer. In some embodiments, the poly(ethylene glycol) molecule is a bifunctional polymer. In some embodiments, the bifunctional polymer is linked to a second polypeptide. In some embodiments, the second polypeptide is an umodified or modified FGF-21 polypeptide.

In some embodiments, the modified FGF-21 polypeptide comprises at least two non-naturally encoded amino acids linked to a water soluble polymer comprising a poly(ethylene glycol) moiety. In some embodiments, one or more non-naturally encoded amino acids are incorporated in one or more of the following positions in modified FGF-21: before position 1 (i.e. at the N-terminus), 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182 (i.e., at the carboxyl terminus of the protein) (amino acid positions corresponding to SEQ ID NO: 1 or the corresponding amino acids in SEQ ID NOs: 2-7). In some embodiments, one or more non-naturally encoded amino acids are incorporated in one or more of the following positions in modified FGF-21: 10, 52, 117, 126, 131, 162, 87, 77, 83, 72, 69, 79, 91, 96, 108, and 110 (amino acid positions corresponding to SEQ ID NO: 1 or the corresponding amino acids of SEQ ID NOs: 2-7). In some embodiments, one or more non-naturally encoded amino acids are incorporated in one or more of the following positions in modified FGF-21: 10, 52, 77, 117, 126, 131, 162 (amino acid positions corresponding to SEQ ID NO: 1 or the corresponding amino acids of SEQ ID NOs: 2-7). In some embodiments, one or more non-naturally encoded amino acids are incorporated in one or more of the following positions in modified FGF-21: 87, 77, 83, 72 (amino acid positions corresponding to SEQ ID NO: 1 or the corresponding amino acids of SEQ ID NOs: 2-7). In some embodiments, one or more non-naturally encoded amino acids are incorporated in one or more of the following positions in modified FGF-21: 69, 79, 91, 96, 108, and 110 (amino acid positions corresponding to SEQ ID NO: 1 or the corresponding amino acids of SEQ ID NOs: 2-7). In some embodiments, one or more non-natural amino acids are incorporated in the leader or signal sequence of SEQ ID NOs: 3, 4, 6, 7, or other unmodified or modified FGF-21 sequence. In some embodiments, leader sequences may be chosen from SEQ ID NOs: 39, 40, 41, 42, 43, or 44. In some embodiments, modified FGF-21 secretion constructs are cloned into pVK7ara (Nde/Eco) with a leader sequences chosen from SEQ ID NOs: 39, 40, 41, 42, 43, or 44.

In some embodiments, the non-naturally occurring amino acid at one or more of these positions is linked to a water soluble polymer, including but not limited to, positions: before position 1 (i.e. at the N-terminus), 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182 (i.e., at the carboxyl terminus of the protein) (amino acid positions corresponding to SEQ ID NO: 1 or the corresponding amino acids in SEQ ID NOs: 2-7). In some embodiments, the non-naturally occurring amino acid at one or more positions from before position 1 (i.e. at the N-terminus) through the C terminus in SEQ ID NOs: 34-36 is linked to a water soluble polymer. In some embodiments, the non-naturally occurring amino acid at one or more of these positions is linked to a water soluble polymer, including but not limited to, positions: 10, 52, 117, 126, 131, 162, 87, 77, 83, 72, 69, 79, 91, 96, 108, and 110 (amino acid positions corresponding to SEQ ID NO: 1 or the corresponding amino acids of SEQ ID NOs: 2-7). In some embodiments, the non-naturally occurring amino acid at one or more of these positions is linked to a water soluble polymer, including but not limited to, positions: 10, 52, 77, 117, 126, 131, 162 (amino acid positions corresponding to SEQ ID NO: 1 or the corresponding amino acids of SEQ ID NOs: 2-7). In some embodiments, the non-naturally occurring amino acid at one or more of these positions is linked to a water soluble polymer: 87, 77, 83, 72 (amino acid positions corresponding to SEQ ID NO: 1 or the corresponding amino acids of SEQ ID NOs: 2-7). In some embodiments, the non-naturally occurring amino acid at one or more of these positions is linked to a water soluble polymer: 69, 79, 91, 96, 108, and 110 (amino acid positions corresponding to SEQ ID NO: 1 or the corresponding amino acids of SEQ ID NOs: 2-7). In some embodiments, the one or more non-naturally occurring amino acids in the leader or signal sequence of SEQ ID NOs: 3, 4, 6, 7, 39, 40, 41, 42, 43, 44, or other modified FGF-21 sequence is linked to a water soluble polymer. In some embodiments, the one or more non-naturally occurring amino acids in the leader or signal sequence of SEQ ID NOs: 3, 4, 6, 7, or other modified FGF-21 sequence is linked to a water soluble polymer.

In some embodiments, the modified FGF-21 polypeptide comprises at least one substitution, addition or deletion that modulates affinity of the modified FGF-21 polypeptide for a FGF-21 polypeptide receptor or binding partner, including but not limited to, a protein, polypeptide, small molecule, or nucleic acid. In some embodiments, the modified FGF-21 polypeptide comprises at least one substitution, addition, or deletion that increases the stability of the modified FGF-21 polypeptide when compared with the stability of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. In some embodiments, the modified FGF-21 polypeptide comprises at least one substitution, addition, or deletion that decreases the immunogenicity of the modified FGF-21 polypeptide when compared with the immunogenicity of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. In some embodiments, the modified FGF-21 polypeptide comprises at least one substitution, addition, or deletion that increases serum half-life or circulation time of the modified FGF-21 polypeptide when compared with the serum half-life or circulation time of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide.

In some embodiments, the modified FGF-21 polypeptide comprises at least one substitution, addition, or deletion that decreases deamidation of the modified FGF-21 polypeptide when compared to deamidation of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. In some embodiments, the modified FGF-21 polypeptide comprises at least one substitution, addition, or deletion that increases the aqueous solubility of the modified FGF-21 polypeptide when compared to aqueous solubility of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. In some embodiments, the modified FGF-21 polypeptide comprises at least one substitution, addition, or deletion that increases the solubility of the modified FGF-21 polypeptide produced in a host cell when compared to the solubility of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. In some embodiments, the modified FGF-21 polypeptide comprises at least one substitution, addition, or deletion that increases the expression of the modified FGF-21 polypeptide in a host cell or increases synthesis in vitro when compared to the expression or synthesis of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. The modified FGF-21 polypeptide comprising this substitution may retain agonist activity and retains or improves expression levels in a host cell. In some embodiments, the modified FGF-21 polypeptide comprises at least one substitution, addition, or deletion that increases protease resistance or reduces protease cleavage (such as cleavage of C-terminal amino acids) of the modified FGF-21 polypeptide when compared to the protease resistance of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. U.S. Pat. No. 6,716,626 indicated that potential sites that may be substituted to alter protease cleavage include, but are not limited to, a monobasic site within 2 residues of a proline. In some embodiments, the modified FGF-21 polypeptide comprises at least one substitution, addition, or deletion that modulates signal transduction activity of the modified FGF-21 receptor when compared with the activity of the receptor upon interaction with the corresponding FGF-21 polypeptide without the at least one substitution, addition, or deletion, or when compared to a comparator compound such as the FGF-21 polypeptide of SEQ ID NO: 1, 201, or another unmodified or modified FGF-21 polypeptide. In some embodiments, the modified FGF-21 polypeptide comprises at least one substitution, addition, or deletion that modulates its binding to another molecule such as a receptor when compared to the binding of the corresponding FGF-21 polypeptide without the at least one substitution, addition, or deletion, or when compared to a comparator compound such as the FGF-21 polypeptide of SEQ ID NO: 1, 201, or another unmodified or modified FGF-21 polypeptide.

In some embodiments, the modified FGF-21 polypeptide comprises at least one substitution, addition, or deletion that increases compatibility of the modified FGF-21 polypeptide with pharmaceutical preservatives (e.g., m-cresol, phenol, benzyl alcohol) when compared to compatibility of the corresponding FGF-21 without the at least one substitution, addition, or deletion, or when compared to a comparator compound such as the FGF-21 polypeptide of SEQ ID NO: 1, 201, or another unmodified or modified FGF-21 polypeptide. This increased compatibility would enable the preparation of a preserved pharmaceutical formulation that maintains the physiochemical properties and biological activity of the protein during storage. WO 2005/091944, which is incorporated by reference in its entirety, discusses the following examples of FGF-21 muteins with enhanced pharmaceutical stability: the substitution with a charged and/or polar but uncharged amino acid for one of the following: glycine 42, glutamine 54, arginine 77, alanine 81, leucine 86, phenylalanine 88, lysine 122, histidine 125, arginine 126, proline 130, arginine 131, leucine 139, alanine 145, leucine 146, isoleucine 152, alanine 154, glutamine 156, glycine 161, serine 163, glycine 170, or serine 172 of SEQ ID NO: 1 of WO 05/091944. A modified FGF-21 polypeptide of the present disclosure may include at least one of these substitutions at the corresponding position in the polypeptide and/or may include one or more other substitutions, additions, or deletions. In some embodiments, one or more non-natural amino acids are substituted at one or more of the following positions: glycine 42, glutamine 54, arginine 77, alanine 81, leucine 86, phenylalanine 88, lysine 122, histidine 125, arginine 126, proline 130, arginine 131, leucine 139, alanine 145, proline/leucine 146, isoleucine 152, alanine 154, glutamine 156, glycine 161, serine 163, glycine 170, serine 172 (amino acid positions corresponding to SEQ ID NO: 1 or the corresponding amino acids in SEQ ID NOs: 2-7). In some embodiments, one or more non-natural amino acids are substituted at one or more of the following positions: glutamate 91, arginine 131, glutamine 108, arginine 77, arginine 72, histidine 87, leucine 86, arginine 126, glutamate 110, tyrosine 83, proline 146, arginine 135, arginine 96, arginine 36, (amino acid positions corresponding to SEQ ID NO: 1 or the corresponding amino acids in SEQ ID NOs: 2-7).

WO 05/091944 describes additional muteins of FGF-21 with enhanced pharmaceutical stability. Such muteins include the substitution of a cysteine for two or more of the following in FGF-21 (see SEQ ID NO: 1 of WO 05/091944): arginine 19, tyrosine 20, leucine 21, tyrosine 22, threonine 23, aspartate 24, aspartate 25, alanine 26, glutamine 27, glutamine 28, alanine 31, leucine 33, isoleucine 35, leucine 37, valine 41, glycine 42, glycine 43, glutamate 50, glutamine 54, leucine 58, valine 62, leucine 66, glycine 67, lysine 69, arginine 72, phenylalanine 73, glutamine 76, arginine 77, aspartate 79, glycine 80, alanine 81, leucine 82, glycine 84, serine 85, proline 90, alanine 92, serine 94, phenylalanine 95, leucine 100, aspartate 102, tyrosine 104, tyrosine 107, serine 109, glutamate 110, proline 115, histidine 117, leucine 118, proline 119, asparagine 121, lysine 122, serine 123, proline 124, histidine 125, arginine 126, aspartate 127, alanine 129, proline 130, glycine 132, alanine 134, arginine 135, leucine 137, proline 138, or leucine 139. Modified FGF-21 polypeptides of the present disclosure may include at least one of these substitutions at the corresponding position in the polypeptide and/or may include one or more other substitutions, additions, or deletions.

WO 05/091944 further describes specific muteins of FGF-21 with engineered disulfide bonds (amino acids substituted with cysteine), in addition to the naturally occurring one at Cys75-Cys93, are as follows: Gln76Cys-Ser109Cys, Cys75-Ser85Cys, Cys75-Ala92Cys, Phe73Cys-Cys93, Ser123Cys-His125Cys, Asp102Cys-Tyr104Cys, Asp127Cys-Gly132Cys, Ser94Cys-Glu110Cys, Pro115Cys-His117Cys, Asn121Cys-Asp127Cys, Leu100Cys-Asp102Cys, Phe95Cys-Tyr107Cys, Arg19CysPro138Cys, Tyr20Cys-Leu139Cys, Tyr22Cys-Leu137Cys, Arg77Cys-Asp79Cys, Pro90Cys-Ala92Cys, Glu50Cys-Lys69Cys, Thr23Cys-Asp25Cys, Ala31Cys-Gly43Cys, Gln28Cys-Gly43Cys, Thr23Cys-Gln28Cys, Val41Cys-Leu82Cys, Leu58Cys-Val62Cys, Gln54Cys-Leu66Cys, Ile35Cys-Gly67Cys, Gly67Cys-Arg72Cys, Ile35Cys-Gly84Cys, Arg72Cys-Gly84Cys, or Arg77Cys-Ala81Cys, where the numbering is based on SEQ ID NO: 1 of WO 05/091944. Additional muteins with engineered disulfide bonds are Tyr22Cys-Leu139Cys; Asp24Cys-Arg135Cys; Leu118Cys-Gly132Cys; His117Cys-Pro130Cys; His117Cys-Ala129Cys; Leu82Cys-Pro119Cys; Gly80Cys-Ala129Cys; Gly43Cys-Pro124Cys; Gly42Cys-Arg126Cys; Gly42Cys-Pro124Cys; Gln28Cys-Pro124Cys; Gln27Cys-Ser123Cys; Ala26Cys-Lys122Cys; or Asp25Cys-Lys122Cys, where the numbering is based on SEQ ID NO: 1 of WO 05/091944. Additional muteins with engineered disulfide bonds are Leu118Cys-Ala134Cys; Leu21Cys-Leu33Cys; Ala26Cys-Lys122Cys; Leu21Cys-Leu33Cys/Leu118Cys-Ala134Cys, where the numbering is based on SEQ ID NO: 1 of WO 05/091944. Modified FGF-21 polypeptides of the present disclosure may include one or more of these substitutions at the corresponding position(s) in the polypeptide and/or may include one or more other substitutions, additions, or deletions.

WO 05/091944 describes additional muteins of FGF-21 that were PEGylated. These muteins had one of the following substitutions: D25C, D38C, L58C, K59C, P60C, K69C, D79C, H87C, E91C, E101C, D102C, L114C, L116C, K122C, R126C, P130C, P133C, P140C. WO 05/091944 describes cysteine substitutions at the following positions: 19, 21, 26, 28, 29, 30, 36, 39, 42, 50, 56, 61, 64, 65, 68, 70, 71, 77, 81, 85, 86, 90, 92, 94, 98, 107, 108, 112, 113, 123, and 124. WO 05/091944 indicates cysteine substitutions at the following positions: 24, 27, 37, 40, 44, 46, 49, 57, 88, 89, 106, 110, 111, 115, 120, and 139. WO 05/091944 also describes cysteine substitutions at the following positions: 18, 45, 47, 48, 78, 83, 99, 103, 125, 128, 131, 132, and 138. WO 05/091944 also describes cysteine substitutions at the following positions: 25, 38, 58, 59, 60, 69, 79, 87, 91, 101, 102, 114, 116, 122, 126, 130, 133, and 140.

Modified FGF-21 polypeptides of the present disclosure may include one or more of the aforementioned substitutions at the corresponding position in the polypeptide and/or may include one or more other substitutions, additions, or deletions. Also provided herein are compositions comprising a modified FGF-21 polypeptide adapted for use in the methods described herein and a pharmaceutically acceptable carrier or excipient In certain embodiments of the disclosure, the modified FGF-21 polypeptide with at least one unnatural amino acid includes at least one post-translational modification. In certain embodiments, the post-translational modification is made in vitro. In certain embodiments, the post-translational modification is made in vivo in a eukaryotic cell or in a non-eukaryotic cell.

In certain embodiments, the protein includes at least one post-translational modification that is made in vivo by one host cell, where the post-translational modification is not normally made by another host cell type. In certain embodiments, the protein includes at least one post-translational modification that is made in vivo by a eukaryotic cell, where the post-translational modification is not normally made by a non-eukaryotic cell. Examples of post-translational modifications include, but are not limited to, glycosylation, acetylation, acylation, lipid-modification, palmitoylation, palmitate addition, phosphorylation, glycolipid-linkage modification, and the like. In certain embodiments, a protein or polypeptide of the disclosure can comprise a secretion or localization sequence, an epitope tag, a FLAG tag, a polyhistidine tag, a GST fusion, and/or the like.

The disclosure also provides water soluble and hydrolytically stable derivatives of PEG derivatives and related hydrophilic polymers having one or more acetylene or azide moieties. The PEG polymer derivatives that contain acetylene moieties are highly selective for coupling with azide moieties that have been introduced selectively into proteins in response to a selector codon. Similarly, PEG polymer derivatives that contain azide moieties are highly selective for coupling with acetylene moieties that have been introduced selectively into proteins in response to a selector codon.

More specifically, the azide moieties comprise, but are not limited to, alkyl azides, aryl azides and derivatives of these azides. The derivatives of the alkyl and aryl azides can include other substituents so long as the acetylene-specific reactivity is maintained. The acetylene moieties comprise alkyl and aryl acetylenes and derivatives of each. The derivatives of the alkyl and aryl acetylenes can include other substituents so long as the azide-specific reactivity is maintained.

The present disclosure provides conjugates of substances having a wide variety of functional groups, substituents or moieties, with other substances including but not limited to a label; a dye; a polymer; a water-soluble polymer; a derivative of polyethylene glycol; a photocrosslinker; a radionuclide; a cytotoxic compound; a drug; an affinity label; a photoaffinity label; a reactive compound; a resin; a second protein or polypeptide or polypeptide analog; an antibody or antibody fragment; a metal chelator; a cofactor; a fatty acid; a carbohydrate; a polynucleotide; a DNA; a RNA; an antisense polynucleotide; a saccharide; a water-soluble dendrimer; a cyclodextrin; an inhibitory ribonucleic acid; a biomaterial; a nanoparticle; a spin label; a fluorophore; a metal-containing moiety; a radioactive moiety; a novel functional group; a group that covalently or noncovalently interacts with other molecules; a photocaged moiety; an actinic radiation excitable moiety; a photoisomerizable moiety; biotin; a derivative of biotin; a biotin analogue; a moiety incorporating a heavy atom; a chemically cleavable group; a photocleavable group; an elongated side chain; a carbon-linked sugar; a redox-active agent; an amino thioacid; a toxic moiety; an isotopically labeled moiety; a biophysical probe; a phosphorescent group; a chemiluminescent group; an electron dense group; a magnetic group; an intercalating group; a chromophore; an energy transfer agent; a biologically active agent; a detectable label; a small molecule; a quantum dot; a nanotransmitter; a radionucleotide; a radiotransmitter; a neutron-capture agent; or any combination of the above, or any other desirable compound or substance. The present disclosure also includes conjugates of substances having azide or acetylene moieties with PEG polymer derivatives having the corresponding acetylene or azide moieties. For example, a PEG polymer containing an azide moiety can be coupled to a biologically active molecule at a position in the protein that contains a non-genetically encoded amino acid bearing an acetylene functionality. The linkage by which the PEG and the biologically active molecule are coupled includes but is not limited to the Huisgen [3+2] cycloaddition product.

In some embodiments, the non-naturally encoded amino acid comprises a carbonyl group, an acetyl group, an aminooxy group, a hydrazine group, a hydrazide group, a semicarbazide group, an azide group, or an alkyne group.

In some embodiments, the non-naturally encoded amino acid comprises a carbonyl group.

In some embodiments, the non-naturally encoded amino acid has the structure:

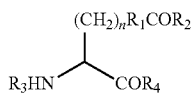

wherein n is 0-10; $R_1$ is an alkyl, aryl, substituted alkyl, or substituted aryl; $R_2$ is H, an alkyl, aryl, substituted alkyl, and substituted aryl; and $R_3$ is H, an amino acid, a polypeptide, or an amino terminus modification group, and $R_4$ is H, an amino acid, a polypeptide, or a carboxy terminus modification group.

In some embodiments, the non-naturally encoded amino acid comprises an aminooxy group. In some embodiments, the non-naturally encoded amino acid comprises a hydrazide group. In some embodiments, the non-naturally encoded amino acid comprises a hydrazine group. In some embodiments, the non-naturally encoded amino acid residue comprises a semicarbazide group.

In some embodiments, the non-naturally encoded amino acid residue comprises an azide group. In some embodiments, the non-naturally encoded amino acid has the structure:

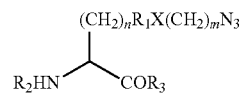

wherein n is 0-10; $R_1$ is an alkyl, aryl, substituted alkyl, substituted aryl or not present; X is O, N, S or not present; m is 0-10; $R_2$ is H, an amino acid, a polypeptide, or an amino terminus modification group, and $R_3$ is H, an amino acid, a polypeptide, or a carboxy terminus modification group.

In some embodiments, the non-naturally encoded amino acid comprises an alkyne group. In some embodiments, the non-naturally encoded amino acid has the structure:

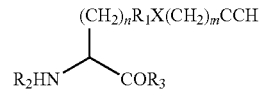

wherein n is 0-10; $R_1$ is an alkyl, aryl, substituted alkyl, or substituted aryl; X is O, N, S or not present; m is 0-10, $R_2$ is H, an amino acid, a polypeptide, or an amino terminus modification group, and $R_3$ is H, an amino acid, a polypeptide, or a carboxy terminus modification group.

In some embodiments, the modified FGF-21 polypeptide may be an agonist, partial agonist, antagonist, partial antagonist, or inverse agonist. In some embodiments, the modified FGF-21 polypeptide comprises a non-naturally encoded amino acid linked to a water soluble polymer. In some embodiments, the water soluble polymer comprises a poly (ethylene glycol) moiety.

The present disclosure also provides isolated nucleic acids comprising a polynucleotide that hybridizes under stringent conditions to SEQ ID NO: 8-14. The present disclosure also provides isolated nucleic acids comprising a polynucleotide that hybridizes under stringent conditions to SEQ ID NO: 8-14 wherein the polynucleotide comprises at least one selector codon. The present disclosure also provides isolated nucleic acids comprising a polynucleotide that encodes the polypeptides shown as SEQ ID NOs: 1-7 or a modified FGF-21 polypeptide described herein. In some embodiments, the isolated polynucleotide described herein comprises at least one selector codon, e.g., a selector codon that encodes a non-naturally encoded amino acid contained in said modified FGF-21 polypeptide.

In some embodiments, the selector codon is selected from the group consisting of an amber codon, ochre codon, opal codon, a unique codon, a rare codon, a five-base codon, and a four-base codon.

The present disclosure also provides methods of making a modified FGF-21 polypeptide linked to a water soluble polymer. In some embodiments, the method comprises contacting an isolated modified FGF-21 polypeptide comprising a non-naturally encoded amino acid with a water soluble polymer comprising a moiety that reacts with the non-naturally encoded amino acid. In some embodiments, the non-naturally encoded amino acid incorporated into the modified FGF-21 polypeptide is reactive toward a water soluble polymer that is otherwise unreactive toward any of the 20 common amino acids. In some embodiments, the non-naturally encoded amino acid incorporated into the modified FGF-21 polypeptide is reactive toward a linker, polymer, or biologically active molecule that is otherwise unreactive toward any of the 20 common amino acids.

In some embodiments, the modified FGF-21 polypeptide linked to the water soluble polymer is made by reacting a modified FGF-21 polypeptide comprising a carbonyl-containing amino acid with a linker, polymer, such as poly(ethylene glycol) molecule, or biologically active molecule, comprising an aminooxy, hydrazine, hydrazide or semicarbazide group. In some embodiments, the aminooxy, hydrazine, hydrazide or semicarbazide group is linked to the poly(ethylene glycol) molecule through an amide linkage.

In some embodiments, the modified FGF-21 polypeptide linked to the water soluble polymer is made by reacting a poly(ethylene glycol) molecule comprising a carbonyl group with a polypeptide comprising a non-naturally encoded amino acid that comprises an aminooxy, hydrazine, hydrazide or semicarbazide group.

In some embodiments, the modified FGF-21 polypeptide linked to the water soluble polymer is made by reacting a modified FGF-21 polypeptide comprising an alkyne-containing amino acid with a poly(ethylene glycol) molecule comprising an azide moiety. In some embodiments, the azide or alkyne group is linked to the poly(ethylene glycol) molecule through an amide linkage.

In some embodiments, the modified FGF-21 polypeptide linked to the water soluble polymer is made by reacting a modified FGF-21 polypeptide comprising an azide-containing amino acid with a poly(ethylene glycol) molecule comprising an alkyne moiety. In some embodiments, the azide or alkyne group is linked to the poly(ethylene glycol) molecule through an amide linkage.

In some embodiments, the water soluble polymer linked to the modified FGF-21 polypeptide comprises a polyalkylene glycol moiety. In some embodiments, the non-naturally encoded amino acid residue incorporated into the modified FGF-21 polypeptide comprises a carbonyl group, an aminooxy group, a hydrazide group, a hydrazine, a semicarbazide group, an azide group, or an alkyne group. In some embodiments, the non-naturally encoded amino acid residue incorporated into the modified FGF-21 polypeptide comprises a carbonyl moiety and the water soluble polymer comprises an aminooxy, hydrazide, hydrazine, or semicarbazide moiety. In some embodiments, the non-naturally encoded amino acid residue incorporated into the modified FGF-21 polypeptide comprises an alkyne moiety and the water soluble polymer comprises an azide moiety. In some embodiments, the non-naturally encoded amino acid residue incorporated into the modified FGF-21 polypeptide comprises an azide moiety and the water soluble polymer comprises an alkyne moiety.

The present disclosure also provides cells comprising a polynucleotide encoding the modified FGF-21 polypeptide comprising a selector codon. In some embodiments, the cells comprise an orthogonal RNA synthetase and/or an orthogonal tRNA for substituting a non-naturally encoded amino acid into the modified FGF-21 polypeptide.

The present disclosure also provides methods of making a modified FGF-21 polypeptide comprising a non-naturally encoded amino acid. In some embodiments, the methods comprise culturing cells comprising a polynucleotide or polynucleotides encoding a modified FGF-21 polypeptide, an orthogonal RNA synthetase and/or an orthogonal tRNA under conditions to permit expression of the modified FGF-21 polypeptide; and purifying the modified FGF-21 polypeptide from the cells and/or culture medium.

Included within the scope of this disclosure is the FGF-21 leader or signal sequence joined to a modified FGF-21 coding region, as well as a heterologous signal sequence joined to a modified FGF-21 coding region. The heterologous leader or signal sequence selected should be one that is recognized and processed, e.g. by host cell secretion system to secrete and possibly cleaved by a signal peptidase, by the host cell. Leader sequences of the present disclosure may be chosen from the following: the three leucine leader from SEQ ID NO: 3 and SEQ ID NO: 6 (amino acid positions 1-28), the two leucine leader from SEQ ID NO: 4 and SEQ ID NO: 7 (amino acid positions 1-27), the His tag from SEQ ID NO: 2 (amino acid positions 1-10), SEQ ID NO: 39, SEQ ID NO: 40, SEQ ID NO: 41, SEQ ID NO: 42, SEQ ID NO: 43, SEQ ID NO: 44. A method of treating a condition or disorder with the modified FGF-21 of the present disclosure is meant to imply treating with a modified FGF-21 polypeptide with or without a signal or leader peptide.

The present disclosure also provides methods of inducing an increase in glucose uptake in adipocyte cells, said method comprising administering modified FGF-21 to said cells in an amount effective to induce an increase in glucose uptake. Said increase in glucose uptake may cause an increase in energy expenditure by faster and more efficient glucose utilization.

II. General Recombinant Nucleic Acids and Methods for Use with the Disclosed Modified FGF-21 Polypeptides In numerous embodiments of the present disclosure, nucleic acids encoding a modified FGF-21 polypeptide of interest may be isolated, cloned and often altered using recombinant methods. Such embodiments may be used, including but not limited to, for protein expression or during the generation of variants, derivatives, expression cassettes, or other sequences derived from a modified FGF-21 polypeptide. In some embodiments, the sequences encoding the modified FGF-21 polypeptides of the disclosure are operably linked to a heterologous promoter. In some embodiments DNA codon usage in the polynucleotide sequences encoding the modified FGF-21 polypeptide may be optimized for *E. coli* or a mammalian cell (e.g. CHO) expression using techniques that are well known in the art An exemplary cDNA encoding the P-form of FGF-21 without the leader sequence is shown as SEQ ID NO: 8. This polypeptide is shown as SEQ ID NO: 1.

An exemplary cDNA encoding a His tagged P-form of FGF-21 without a leader sequence is shown as SEQ ID NO: 9. This polypeptide is shown as SEQ ID NO: 2.

An exemplary cDNA encoding the P-form of FGF-21 with a leader sequence containing 3 leucines together is shown as SEQ ID NO: 10. This polypeptide is shown as SEQ ID NO: 3.

An exemplary cDNA encoding the P-form of FGF-21 with a leader sequence containing 2 leucines together is shown as SEQ ID NO: 11. This polypeptide is shown as SEQ ID NO: 4.

An exemplary cDNA encoding the L-form of FGF-21 without the leader sequence is shown as SEQ ID NO: 12. This polypeptide is shown as SEQ ID NO: 5.

An exemplary cDNA encoding the L-form of FGF-21 with a leader sequence containing 3 leucines together is shown as SEQ ID NO: 13. This polypeptide is shown as SEQ ID NO: 6.

An exemplary cDNA encoding the L-form of FGF-21 with a leader sequence containing 2 leucines together is shown as SEQ ID NO: 14. This polypeptide is shown as SEQ ID NO: 7.

A nucleotide sequence encoding a modified FGF-21 polypeptide described herein may be synthesized on the basis of the amino acid sequence of the parent polypeptide, including but not limited to, having the amino acid sequence shown in SEQ ID NO: 1-7 and then changing the nucleotide sequence so as to effect introduction (i.e., incorporation or substitution) or removal (i.e., deletion or substitution) of the relevant amino acid residue(s). The nucleotide sequence may be conveniently modified by site-directed mutagenesis in accordance with conventional methods. Alternatively, the nucleotide sequence may be prepared by chemical synthesis, including but not limited to, by using an oligonucleotide synthesizer, wherein oligonucleotides are designed based on the amino acid sequence of the desired polypeptide, and preferably selecting those codons that are favored in the host cell in which the recombinant polypeptide is to be be produced. For example, several small oligonucleotides coding for portions of the desired polypeptide may be synthesized and assembled by PCR, ligation or ligation chain reaction. See, e.g., Barany, et al., *Proc. Nati. Acad. Sci.* 88: 189-193 (1991); U.S. Pat. No. 6,521,427 which are incorporated by reference herein.

The disclosure also relates to eukaryotic host cells, non-eukaryotic host cells, and organisms for the in vivo incorporation of an unnatural amino acid via orthogonal tRNA/RS pairs. Host cells are genetically engineered (including but not limited to, transformed, transduced or transfected) with the polynucleotides of the disclosure or constructs which include a polynucleotide of the disclosure, including but not limited to, a vector of the disclosure, which can be, for example, a cloning vector or an expression vector. For example, the coding regions for the orthogonal tRNA, the orthogonal tRNA synthetase, and the protein to be derivatized are operably linked to gene expression control elements that are functional in the desired host cell. The vector can be, for example, in the form of a plasmid, a cosmid, a phage, a bacterium, a virus, a naked polynucleotide, or a conjugated polynucleotide. The vectors may be introduced into cells and/or microorganisms by standard methods.

Selector Codons

Selector codons of the disclosure expand the genetic codon framework of protein biosynthetic machinery. For example, a selector codon includes, but is not limited to, a unique three base codon, a nonsense codon, such as a stop codon, including but not limited to, an amber codon (UAG), an ochre codon, or an opal codon (UGA), an unnatural codon, a four or more base codon, a rare codon, or the like. It is readily apparent to those of ordinary skill in the art that there is a wide range in the number of selector codons that can be introduced into a desired gene or polynucleotide, including but not limited to, one or more, two or more, three or more, 4, 5, 6, 7, 8, 9, 10 or more in a single polynucleotide encoding at least a portion of the modified FGF-21 polypeptide.

In one embodiment, the methods involve the use of a selector codon that is a stop codon for the incorporation of one or more unnatural (i.e., non-naturally encoded) amino acids in vivo. For example, an O-tRNA is produced that recognizes the stop codon, including but not limited to, UAG, and is aminoacylated by an O-RS with a desired unnatural amino acid. This O-tRNA is not recognized by the naturally occurring host's aminoacyl-tRNA synthetases. Conventional site-directed mutagenesis can be used to introduce the stop codon, including but not limited to, TAG, at the site of interest in a polypeptide of interest. See, e.g., Sayers, J. R., et al. (1988), *5'-3' Exonucleases in phosphorothioate-based oligonucleotide-directed mutagenesis. Nucleic Acids Res,* 16:791-802. When the O-RS, O-tRNA and the nucleic acid that encodes the polypeptide of interest are combined in vivo, the unnatural amino acid is incorporated in response to the UAG codon to give a polypeptide containing the unnatural amino acid at the specified position.

The incorporation of unnatural amino acids in vivo can be done without significant perturbation of the eukaryotic host cell. For example, because the suppression efficiency for the UAG codon depends upon the competition between the O-tRNA, including but not limited to, the amber suppressor tRNA, and a eukaryotic release factor (including but not limited to, eRF) (which binds to a stop codon and initiates release of the growing peptide from the ribosome), the suppression efficiency can be modulated by, including but not limited to, increasing the expression level of O-tRNA, and/or the suppressor tRNA.

Unnatural amino acids can also be encoded with rare codons. For example, when the arginine concentration in an in vitro protein synthesis reaction is reduced, the rare arginine codon, AGG, has proven to be efficient for insertion of Ala by a synthetic tRNA acylated with alanine. See, e.g., Ma et al., *Biochemistry,* 32:7939 (1993). In this case, the synthetic tRNA competes with the naturally occurring tRNAArg, which exists as a minor species in *Escherichia coli*. Some organisms do not use all triplet codons. An unassigned codon AGA in *Micrococcus luteus* has been utilized for insertion of amino acids in an in vitro transcription/translation extract. See, e.g., Kowal and Oliver, *Nucl. Acid. Res.,* 25:4685 (1997). Components of the present disclosure can be generated to use these rare codons in vivo.

Selector codons also comprise extended codons, including but not limited to, four or more base codons, such as, four, five, six or more base codons. Examples of four base codons include, but are not limited to, AGGA, CUAG, UAGA, CCCU and the like. Examples of five base codons include, but are not limited to, AGGAC, CCCCU, CCCUC, CUAGA, CUACU, UAGGC and the like. A feature of the disclosure includes using extended codons based on frameshift suppression. Four or more base codons can insert, including but not limited to, one or multiple unnatural amino acids into the same protein. For example, in the presence of mutated O-tRNAs, including but not limited to, a special frameshift suppressor tRNAs, with anticodon loops, for example, with at least 8-10 nt anticodon loops, the four or more base codon is read as single amino acid. In other embodiments, the anticodon loops can decode, including but not limited to, at least a four-base codon, at least a five-base codon, or at least a six-base codon or more. Since there are 256 possible four-base codons, multiple unnatural amino acids can be encoded in the same cell using a four or more base codon.

In one embodiment, extended codons based on rare codons or nonsense codons can be used in the present disclosure, which can reduce missense readthrough and frameshift suppression at other unwanted sites.

For a given system, a selector codon can also include one of the natural three base codons, where the endogenous system does not use (or rarely uses) the natural base codon. For example, this includes a system that is lacking a tRNA that recognizes the natural three base codon, and/or a system where the three base codon is a rare codon.

Selector codons optionally include unnatural base pairs. These unnatural base pairs further expand the existing genetic alphabet. One extra base pair increases the number of triplet codons from 64 to 125. Properties of third base pairs include stable and selective base pairing, efficient enzymatic incorporation into DNA with high fidelity by a polymerase, and the efficient continued primer extension after synthesis of the nascent unnatural base pair. Descriptions of unnatural base pairs which can be adapted for methods and compositions include, e.g., Hirao, et al., (2002), *Nature Biotechnology*, 20:177-182. See, also, Wu, Y., et al., (2002) *J. Am. Chem. Soc.* 124:14626-14630.

Genes coding for proteins or polypeptides of interest such as a modified FGF-21 polypeptide can be mutagenized using methods known to one of ordinary skill in the art and described herein to include, for example, one or more selector codon for the incorporation of an unnatural amino acid. For example, a nucleic acid for a protein of interest is mutagenized to include one or more selector codon, providing for the incorporation of one or more unnatural amino acids. The disclosure includes any such variant, including but not limited to, mutant, versions of any protein, for example, including at least one unnatural amino acid.

Nucleic acid molecules encoding a protein of interest such as a modified FGF-21 polypeptide may be readily mutated to introduce a cysteine at any desired position of the polypeptide. Cysteine is widely used to introduce reactive molecules, water soluble polymers, proteins, or a wide variety of other molecules, onto a protein of interest.

III. Non-Naturally Encoded Amino Acids

A very wide variety of non-naturally encoded amino acids are suitable for use in the present disclosure. Any number of non-naturally encoded amino acids can be introduced into a modified FGF-21 polypeptide. In general, the introduced non-naturally encoded amino acids are substantially chemically inert toward the 20 common, genetically-encoded amino acids (i.e., alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, and valine). In some embodiments, the non-naturally encoded amino acids include side chain functional groups that react efficiently and selectively with functional groups not found in the 20 common amino acids (including but not limited to, azido, ketone, aldehyde and aminooxy groups) to form stable conjugates. For example, a modified FGF-21 polypeptide that includes a non-naturally encoded amino acid containing an azido functional group can be reacted with a polymer (including but not limited to, poly(ethylene glycol) or, alternatively, a second polypeptide containing an alkyne moiety to form a stable conjugate resulting for the selective reaction of the azide and the alkyne functional groups to form a Huisgen [3+2] cycloaddition product.

The generic structure of an alpha-amino acid is illustrated as follows (Formula I):

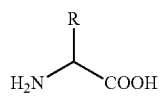

I

A non-naturally encoded amino acid is typically any structure having the above-listed formula wherein the R group is any substituent other than one used in the twenty natural amino acids, and may be suitable for use in the modified FGF-21 polypeptides of the present disclosure. Because the non-naturally encoded amino acids of the disclosure typically differ from the natural amino acids only in the structure of the side chain, the non-naturally encoded amino acids form amide bonds with other amino acids, including but not limited to, natural or non-naturally encoded, in the same manner in which they are formed in naturally occurring polypeptides. However, the non-naturally encoded amino acids have side chain groups that distinguish them from the natural amino acids. For example, R optionally comprises an alkyl-, aryl-, acyl-, keto-, azido-, hydroxyl-, hydrazine, cyano-, halo-, hydrazide, alkenyl, alkynl, ether, thiol, seleno-, sulfonyl-, borate, boronate, phospho, phosphono, phosphine, heterocyclic, enone, imine, aldehyde, ester, thioacid, hydroxylamine, amino group, or the like or any combination thereof Exemplary non-naturally encoded amino acids that may be suitable for use in the present disclosure and that are useful for reactions with water soluble polymers include, but are not limited to, those with carbonyl, aminooxy, hydrazine, hydrazide, semicarbazide, azide and alkyne reactive groups. In some embodiments, non-naturally encoded amino acids comprise a saccharide moiety. Examples of such amino acids include N-acetyl-L-glucosaminyl-L-serine, N-acetyl-L-galactosaminyl-L-serine, N-acetyl-L-glucosaminyl-L-threonine, N-acetyl-L-glucosaminyl-L-asparagine and O-mannosaminyl-L-serine.

Many of the non-naturally encoded amino acids provided herein are commercially available, e.g., from Sigma-Aldrich (St. Louis, Mo., USA), Novabiochem (a division of EMD Biosciences, Darmstadt, Germany), or Peptech (Burlington, Mass., USA). Those that are not commercially available are optionally synthesized as provided herein or using standard methods known to those of ordinary skill in the art. For organic synthesis techniques, see, e.g., *Organic Chemistry* by Fessendon and Fessendon, (1982, Second Edition, Willard Grant Press, Boston Mass.); *Advanced Organic Chemistry* by March (Third Edition, 1985, Wiley and Sons, New York); and *Advanced Organic Chemistry* by Carey and Sundberg (Third Edition, Parts A and B, 1990, Plenum Press, New York). See, also, U.S. Pat. Nos. 7,045,337 and 7,083,970, which are incorporated by reference herein. In addition to unnatural amino acids that contain novel side chains, unnatural amino acids that may be suitable for use in the present disclosure also optionally comprise modified backbone structures, including but not limited to, as illustrated by the structures of Formula II and III:

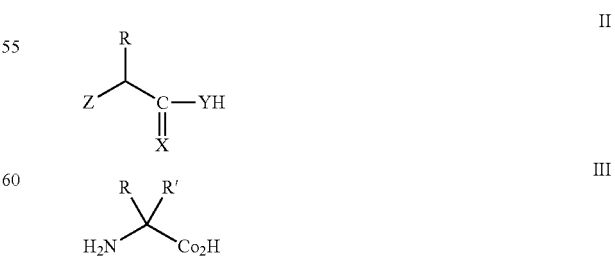

wherein Z typically comprises OH, $NH_2$, SH, NH—R', or S—R'; X and Y, which can be the same or different, typically comprise S or O, and R and R', which are optionally the same or different, are typically selected from the same list of constituents for the R group described above for the unnatural amino acids having Formula I as well as hydrogen. For example, unnatural amino acids of the disclosure optionally comprise substitutions in the amino or carboxyl group as illustrated by Formulas II and III. Unnatural amino acids of this type include, but are not limited to, α-hydroxy acids, α-thioacids, α-aminothiocarboxylates, including but not limited to, with side chains corresponding to the common twenty natural amino acids or unnatural side chains. In addition, substitutions at the α-carbon optionally include, but are not limited to, L, D, or α-α-disubstituted amino acids such as D-glutamate, D-alanine, D-methyl-O-tyrosine, aminobutyric acid, and the like. Other structural alternatives include cyclic amino acids, such as proline analogues as well as 3, 4, 6, 7, 8, and 9 membered ring proline analogues, β and γ amino acids such as substituted β-alanine and γ-amino butyric acid.

Many unnatural amino acids are based on natural amino acids, such as tyrosine, glutamine, phenylalanine, and the like, and are suitable for use in the present disclosure. Tyrosine analogs include, but are not limited to, para-substituted tyrosines, ortho-substituted tyrosines, and meta substituted tyrosines, where the substituted tyrosine comprises, including but not limited to, a keto group (including but not limited to, an acetyl group), a benzoyl group, an amino group, a hydrazine, an hydroxyamine, a thiol group, a carboxy group, an isopropyl group, a methyl group, a $C_6$-$C_{20}$ straight chain or branched hydrocarbon, a saturated or unsaturated hydrocarbon, an O-methyl group, a polyether group, a nitro group, an alkynyl group or the like. In addition, multiply substituted aryl rings are also contemplated. Glutamine analogs that may be suitable for use in the present disclosure include, but are not limited to, α-hydroxy derivatives, γ-substituted derivatives, cyclic derivatives, and amide substituted glutamine derivatives. Example phenylalanine analogs that may be suitable for use in the present disclosure include, but are not limited to, para-substituted phenylalanines, ortho-substituted phenylalanines, and meta-substituted phenylalanines, where the substituent comprises, including but not limited to, a hydroxy group, a methoxy group, a methyl group, an allyl group, an aldehyde, an azido, an iodo, a bromo, a keto group (including but not limited to, an acetyl group), a benzoyl, an alkynyl group, or the like. Specific examples of unnatural amino acids that may be suitable for use in the present disclosure include, but are not limited to, a p-acetyl-L-phenylalanine, an O-methyl-L-tyrosine, an L-3-(2-naphthyl)alanine, a 3-methyl-phenylalanine, an O-4-allyl-L-tyrosine, a 4-propyl-L-tyrosine, a tri-O-acetyl-GlcNAcβ-serine, an L-Dopa, a fluorinated phenylalanine, an isopropyl-L-phenylalanine, a p-azido-L-phenylalanine, a p-acyl-L-phenylalanine, a p-benzoyl-L-phenylalanine, an L-phosphoserine, a phosphonoserine, a phosphonotyrosine, a p-iodo-phenylalanine, a p-bromophenylalanine, a p-amino-L-phenylalanine, an isopropyl-L-phenylalanine, and a p-propargyloxy-phenylalanine, and the like.

In one embodiment, compositions of a modified FGF-21 polypeptide comprising an unnatural amino acid (such as p-(propargyloxy)-phenylalanine) are provided. Various compositions comprising p-(propargyloxy)-phenylalanine and, including but not limited to, proteins and/or cells, are also provided. In one aspect, a composition that includes the p-(propargyloxy)-phenylalanine unnatural amino acid, further includes an orthogonal tRNA. The unnatural amino acid can be bonded (including but not limited to, covalently) to the orthogonal tRNA, including but not limited to, covalently bonded to the orthogonal tRNA though an amino-acyl bond, covalently bonded to a 3'OH or a 2'OH of a terminal ribose sugar of the orthogonal tRNA, etc.

The modified FGF-21 polypeptide described herein may comprise a non-naturally encoded amino acid described in U.S. Pat. No. 8,012,931, which is incorporated herein by reference in its entirety.

Structure and Synthesis of Non-Natural Amino Acids: Carbonyl, Carbonyl-Like, Masked Carbonyl, Protected Carbonyl Groups, and Hydroxylamine Groups In some embodiments the present disclosure provides modified FGF-21 linked to a water soluble polymer, e.g., a PEG, by an oxime bond. Many types of non-naturally encoded amino acids are suitable for formation of oxime bonds. These include, but are not limited to, non-naturally encoded amino acids containing a carbonyl, dicarbonyl, carbonyl-like, masked carbonyl, protected carbonyl, or hydroxylamine group. Such amino acids, their structure and synthesis are described in U.S. Pat. No. 8,012,931, which is incorporated herein by reference in its entirety.

IV. Structure and Synthesis of Non-Natural Amino Acids: Hydroxylamine-Containing Amino Acids U.S. Provisional Patent Application No. 60/638,418 is incorporated by reference in its entirety. Thus, the disclosures provided in Section V (entitled "Non-natural Amino Acids"), Part B (entitled "Structure and Synthesis of Non-Natural Amino Acids: Hydroxylamine-Containing Amino Acids"), in U.S. Provisional Patent Application No. 60/638,418 apply fully to the methods, compositions, techniques and strategies for making, purifying, characterizing, and using non-natural amino acids, non-natural amino acid polypeptides and modified non-natural amino acid polypeptides described herein to the same extent as if such disclosures were fully presented herein. U.S. Patent Publication Nos. 2006/0194256, 2006/0217532, and 2006/0217289 and WO 2006/069246 entitled "Compositions containing, methods involving, and uses of non-natural amino acids and polypeptides," are also incorporated herein by reference in their entirety.

Chemical Synthesis of Unnatural Amino Acids

Many of the unnatural amino acids suitable for use in the present disclosure are commercially available, e.g., from Sigma (USA) or Aldrich (Milwaukee, Wis., USA). Those that are not commercially available are optionally synthesized as provided herein or as provided in various publications or using standard methods known to those of ordinary skill in the art. For organic synthesis techniques, see, e.g., *Organic Chemistry* by Fessendon and Fessendon, (1982, Second Edition, Willard Grant Press, Boston Mass.); *Advanced Organic Chemistry* by March (Third Edition, 1985, Wiley and Sons, New York); and *Advanced Organic Chemistry* by Carey and Sundberg (Third Edition, Parts A and B, 1990, Plenum Press, New York). Additional publications describing the synthesis of unnatural amino acids include, e.g., WO 2002/085923 entitled "In vivo incorporation of Unnatural Amino Acids;" Matsoukas et al., (1995) *J. Med. Chem.*, 38, 4660-4669; King, F. E. & Kidd, D. A. A. (1949) *A New Synthesis of Glutamine and of γ-Dipeptides of Glutamic Acid from Phthylated Intermediates. J. Chem. Soc.*, 3315-3319; Friedman, O. M. & Chatterrji, R. (1959) *Synthesis of Derivatives of Glutamine as Model Substrates for Anti-Tumor Agents. J. Am. Chem. Soc.* 81, 3750-3752; Craig, J. C. et al. (1988) *Absolute Configuration of the Enantiomers of 7-Chloro-*4[[4-*(diethylamino)*-1-*methylbutyl]amino]quinoline (Chloroquine). J. Org. Chem.* 53, 1167-1170; Azoulay, M., Vilmont, M. & Frappier, F. (1991) *Glutamine analogues as Potential Antimalarials, Eur. J.*

Med. Chem. 26, 201-5; Koskinen, A. M. P. & Rapoport, H. (1989) *Synthesis of 4-Substituted Prolines as Conformationally Constrained Amino Acid Analogues. J. Org. Chem.* 54, 1859-1866; Christie, B. D. & Rapoport, H. (1985) *Synthesis of Optically Pure Pipecolates from L-Asparagine. Application to the Total Synthesis of (+)-Apovincamine through Amino Acid Decarbonylation and Iminium Ion Cyclization. J. Org. Chem.* 50:1239-1246; Barton et al., (1987) *Synthesis of Novel alpha-Amino-Acids and Derivatives Using Radical Chemistry: Synthesis of L- and D-alpha-Amino-Adipic Acids, L-alpha-aminopimelic Acid and Appropriate Unsaturated Derivatives. Tetrahedron* 43:4297-4308; and, Subasinghe et al., (1992) *Quisqualic acid analogues: synthesis of beta-heterocyclic 2-aminopropanoic acid derivatives and their activity at a novel quisqualate-sensitized site. J. Med. Chem.* 35:4602-7. See also, U.S. Patent Publication No. U.S. 2004/0198637 entitled "Protein Arrays," which is incorporated by reference herein.

A. Carbonyl Reactive Groups

Amino acids with a carbonyl reactive group allow for a variety of reactions to link molecules (including but not limited to, PEG or other water soluble molecules) via nucleophilic addition or aldol condensation reactions among others.

The synthesis of p-acetyl-(+/−)-phenylalanine and m-acetyl-(+/−)-phenylalanine is described in Zhang, Z., et al., Biochemistry 42: 6735-6746 (2003), which is incorporated by reference herein. Other carbonyl-containing amino acids can be similarly prepared by one of ordinary skill in the art.

In some embodiments, a modified FGF-21 polypeptide comprising a non-naturally encoded amino acid may be chemically modified to generate a reactive carbonyl functional group. For instance, an aldehyde functionality useful for conjugation reactions can be generated from a functionality having adjacent amino and hydroxyl groups. Where the biologically active molecule is a polypeptide, for example, an N-terminal serine or threonine (which may be normally present or may be exposed via chemical or enzymatic digestion) can be used to generate an aldehyde functionality under mild oxidative cleavage conditions using periodate. See, e.g., Gaertner, et al., *Bioconjug. Chem.* 3: 262-268 (1992); Geoghegan, K. & Stroh, J., *Bioconjug. Chem.* 3:138-146 (1992); Gaertner et al., *J. Biol. Chem.* 269:7224-7230 (1994). However, methods known in the art are restricted to the amino acid at the N-terminus of the peptide or protein.

In the present disclosure, a non-naturally encoded amino acid bearing adjacent hydroxyl and amino groups can be incorporated into the polypeptide as a "masked" aldehyde functionality. For example, 5-hydroxylysine bears a hydroxyl group adjacent to the epsilon amine. Reaction conditions for generating the aldehyde typically involve addition of molar excess of sodium metaperiodate under mild conditions to avoid oxidation at other sites within the polypeptide. The pH of the oxidation reaction is typically about 7.0. A typical reaction involves the addition of about 1.5 molar excess of sodium meta periodate to a buffered solution of the polypeptide, followed by incubation for about 10 minutes in the dark. See, e.g. U.S. Pat. No. 6,423,685, which is incorporated by reference herein.

The carbonyl functionality can be reacted selectively with a hydrazine-, hydrazide-, hydroxylamine-, or semicarbazide-containing reagent under mild conditions in aqueous solution to form the corresponding hydrazone, oxime, or semicarbazone linkages, respectively, that are stable under physiological conditions. See, e.g., Jencks, W. P., *J. Am. Chem. Soc.* 81, 475-481 (1959); Shao, J. and Tam, J. P., *J. Am. Chem. Soc.* 117:3893-3899 (1995). Moreover, the unique reactivity of the carbonyl group allows for selective modification in the presence of the other amino acid side chains. See, e.g., Cornish, V. W., et al., *J. Am. Chem. Soc.* 118:8150-8151 (1996); Geoghegan, K. F. & Stroh, J. G., *Bioconjug. Chem.* 3:138-146 (1992); Mahal, L. K., et al., *Science* 276:1125-1128 (1997).

B. Hydrazine, Hydrazide or Semicarbazide Reactive Groups

Non-naturally encoded amino acids containing a nucleophilic group, such as a hydrazine, hydrazide or semicarbazide, allow for reaction with a variety of electrophilic groups to form conjugates (including but not limited to, with PEG or other water soluble polymers).

Hydrazide-, hydrazine-, and semicarbazide-containing amino acids are available from commercial sources. For instance, L-glutamate-γ-hydrazide is available from Sigma Chemical (St. Louis, Mo.). Other amino acids not available commercially can be prepared by one of ordinary skill in the art. See, e.g., U.S. Pat. No. 6,281,211, which is incorporated by reference herein.

Modified FGF-21 polypeptides containing non-naturally encoded amino acids that bear hydrazide, hydrazine or semicarbazide functionalities can be reacted efficiently and selectively with a variety of molecules that contain aldehydes or other functional groups with similar chemical reactivity. See, e.g., Shao, J. and Tam, J., *J. Am. Chem. Soc.* 117:3893-3899 (1995). The unique reactivity of hydrazide, hydrazine and semicarbazide functional groups makes them significantly more reactive toward aldehydes, ketones and other electrophilic groups as compared to the nucleophilic groups present on the 20 common amino acids (including but not limited to, the hydroxyl group of serine or threonine or the amino groups of lysine and the N-terminus).

C. Aminooxy-Containing Amino Acids

Non-naturally encoded amino acids containing an aminooxy (also called a hydroxylamine) group allow for reaction with a variety of electrophilic groups to form conjugates (including but not limited to, with PEG or other water soluble polymers). Like hydrazines, hydrazides and semicarbazides, the enhanced nucleophilicity of the aminooxy group permits it to react efficiently and selectively with a variety of molecules that contain aldehydes or other functional groups with similar chemical reactivity. See, e.g., Shao, J. and Tam, J., *J. Am. Chem. Soc.* 117:3893-3899 (1995); H. Hang and C. Bertozzi, *Acc. Chem. Res.* 34: 727-736 (2001). Whereas the result of reaction with a hydrazine group is the corresponding hydrazone, however, an oxime results generally from the reaction of an aminooxy group with a carbonyl-containing group such as a ketone.

Aminooxy-containing amino acids can be prepared from readily available amino acid precursors (homoserine, serine and threonine). See, e.g., M. Carrasco and R. Brown, *J. Org. Chem.* 68: 8853-8858 (2003). Certain aminooxy-containing amino acids, such as L-2-amino-4-(aminooxy)butyric acid), have been isolated from natural sources (Rosenthal, G., *Life Sci.* 60: 1635-1641 (1997). Other aminooxy-containing amino acids can be prepared by one of ordinary skill in the art.

D. Azide and Alkyne Reactive Groups

The unique reactivity of azide and alkyne functional groups makes them extremely useful for the selective modification of polypeptides and other biological molecules. Organic azides, particularly alphatic azides, and alkynes are generally stable toward common reactive chemical conditions. In particular, both the azide and the alkyne functional groups are inert toward the side chains (i.e., R groups) of the 20 common amino acids found in naturally-occurring polypeptides. When brought into close proximity, however, the "spring-loaded" nature of the azide and alkyne groups is revealed and they react selectively and efficiently via Huisgen [3+2] cycloaddition reaction to generate the corresponding triazole. See, e.g., Chin J., et al., *Science* 301:964-7 (2003); Wang, Q., et al., *J. Am. Chem. Soc.* 125, 3192-3193 (2003); Chin, J. W., et al., *J. Am. Chem. Soc.* 124:9026-9027 (2002).

Because the Huisgen cycloaddition reaction involves a selective cycloaddition reaction (see, e.g., Padwa, A., in COMPREHENSIVE ORGANIC SYNTHESIS, Vol. 4, (ed. Trost, B. M., 1991), p. 1069-1109; Huisgen, R. in 1,3-DIPOLAR CYCLOADDITION CHEMISTRY, (ed. Padwa, A., 1984), p. 1-176) rather than a nucleophilic substitution, the incorporation of non-naturally encoded amino acids bearing azide and alkyne-containing side chains permits the resultant polypeptides to be modified selectively at the position of the non-naturally encoded amino acid. Cycloaddition reaction involving azide or alkyne-containing modified FGF-21 polypeptide can be carried out at room temperature under aqueous conditions by the addition of Cu(II) (including but not limited to, in the form of a catalytic amount of $CuSO_4$) in the presence of a reducing agent for reducing Cu(II) to Cu(I), in situ, in catalytic amount. See, e.g., Wang, Q., et al., *J. Am. Chem. Soc.* 125, 3192-3193 (2003); Tornoe, C. W., et al., *J. Org. Chem.* 67:3057-3064 (2002); Rostovtsev, et al., *Angew. Chem. Int. Ed.* 41:2596-2599 (2002). Exemplary reducing agents include, including but not limited to, ascorbate, metallic copper, quinine, hydroquinone, vitamin K, glutathione, cysteine, $Fe^{2+}$, $Co^{2+}$, and an applied electric potential.

In some cases, where a Huisgen [3+2] cycloaddition reaction between an azide and an alkyne is desired, the modified FGF-21 polypeptide may comprise a non-naturally encoded amino acid comprising an alkyne moiety and the water soluble polymer to be attached to the amino acid may comprise an azide moiety. Alternatively, the converse reaction (i.e., with the azide moiety on the amino acid and the alkyne moiety present on the water soluble polymer) can also be performed.

The azide functional group can also be reacted selectively with a water soluble polymer containing an aryl ester and appropriately functionalized with an aryl phosphine moiety to generate an amide linkage. The aryl phosphine group reduces the azide in situ and the resulting amine then reacts efficiently with a proximal ester linkage to generate the corresponding amide. See, e.g., E. Saxon and C. Bertozzi, *Science* 287, 2007-2010 (2000). The azide-containing amino acid can be either an alkyl azide (including but not limited to, 2-amino-6-azido-1-hexanoic acid) or an aryl azide (p-azido-phenylalanine).

The azide functional group can also be reacted selectively with a water soluble polymer containing a thioester and appropriately functionalized with an aryl phosphine moiety to generate an amide linkage. The aryl phosphine group reduces the azide in situ and the resulting amine then reacts efficiently with the thioester linkage to generate the corresponding amide.

Alkyne-containing amino acids are commercially available. For example, propargylglycine is commercially available from Peptech (Burlington, Mass.). Alternatively, alkyne-containing amino acids can be prepared according to standard methods. For instance, p-propargyloxyphenylalanine can be synthesized, for example, as described in Deiters, A., et al., *J. Am. Chem. Soc.* 125: 11782-11783 (2003), and 4-alkynyl-L-phenylalanine can be synthesized as described in Kayser, B., et al., *Tetrahedron* 53(7): 2475-2484 (1997). Other alkyne-containing amino acids can be prepared by one of ordinary skill in the art.

Azide-containing amino acids are available from commercial sources. For instance, 4-azidophenylalanine can be obtained from Chem-Impex International, Inc. (Wood Dale, Ill.). For those azide-containing amino acids that are not commercially available, the azide group can be prepared relatively readily using standard methods known to those of ordinary skill in the art, including but not limited to, via displacement of a suitable leaving group (including but not limited to, halide, mesylate, tosylate) or via opening of a suitably protected lactone. See, e.g., *Advanced Organic Chemistry* by March (Third Edition, 1985, Wiley and Sons, New York).

A molecule that can be added to a protein of the disclosure through a [3+2] cycloaddition includes virtually any molecule with an azide or alkynyl derivative. Molecules include, but are not limited to, dyes, fluorophores, crosslinking agents, saccharide derivatives, polymers (including but not limited to, polymers comprising polyethylene glycol), photocrosslinkers, cytotoxic compounds, affinity labels, derivatives of biotin, resins, beads, a second protein or polypeptide (or more), polynucleotide(s) (including but not limited to, DNA, RNA, etc.), metal chelators, cofactors, fatty acids, carbohydrates, and the like. These molecules can be added to an unnatural amino acid with an alkynyl group, including but not limited to, p-propargyloxyphenylalanine, or azido group, including but not limited to, p-azido-phenylalanine, respectively.

E. Aminothiol Reactive Groups

The unique reactivity of beta-substituted aminothiol functional groups makes them extremely useful for the selective modification of polypeptides and other biological molecules that contain aldehyde groups via formation of the thiazolidine. See, e.g., J. Shao and J. Tam, *J. Am. Chem. Soc.* 1995, 117 (14) 3893-3899. In some embodiments, beta-substituted aminothiol amino acids can be incorporated into modified FGF-21 polypeptides and then reacted with water soluble polymers comprising an aldehyde functionality. In some embodiments, a water soluble polymer, drug conjugate or other payload can be coupled to a modified FGF-21 polypeptide comprising a beta-substituted aminothiol amino acid via formation of the thiazolidine.

F. Additional Reactive Groups

Additional reactive groups and non-naturally encoded amino acids that can be incorporated into modified FGF-21 polypeptides of the disclosure are described in the following patent applications which are all incorporated by reference in their entirety herein: U.S. Patent Publication No. 2006/0194256, U.S. Patent Publication No. 2006/0217532, U.S. Patent Publication No. 2006/0217289, U.S. Provisional Patent No. 60/755,338; U.S. Provisional Patent No. 60/755,711; U.S. Provisional Patent No. 60/755,018; International Patent Application No. PCT/US06/49397; WO 2006/069246; U.S. Provisional Patent No. 60/743,041; U.S. Provisional Patent No. 60/743,040; International Patent Application No. PCT/US06/47822; U.S. Provisional Patent No. 60/882,819; U.S. Provisional Patent No. 60/882,500; and U.S. Provisional Patent No. 60/870,594.

Cellular Uptake of Unnatural Amino Acids

Unnatural amino acid uptake by a cell is one issue that is typically considered when designing and selecting unnatural amino acids, including but not limited to, for incorporation into a protein. For example, the high charge density of α-amino acids suggests that these compounds are unlikely to be cell permeable. Natural amino acids are taken up into the eukaryotic cell via a collection of protein-based transport systems. A rapid screen can be done which assesses which unnatural amino acids, if any, are taken up by cells. See, e.g., the toxicity assays in, e.g., U.S. Patent Publication No. U.S. 2004/0198637 entitled "Protein Arrays" which is incorporated by reference herein; and Liu, D. R. & Schultz, P. G. (1999) *Progress toward the evolution of an organism with an expanded genetic code. PNAS United States* 96:4780-4785. Although uptake is easily analyzed with various assays, an alternative to designing unnatural amino acids that are amenable to cellular uptake pathways is to provide biosynthetic pathways to create amino acids in vivo.

Biosynthesis of Unnatural Amino Acids

Many biosynthetic pathways already exist in cells for the production of amino acids and other compounds. While a biosynthetic method for a particular unnatural amino acid may not exist in nature, including but not limited to, in a cell, the disclosure provides such methods. For example, biosynthetic pathways for unnatural amino acids are optionally generated in host cell by adding new enzymes or modifying existing host cell pathways. Additional new enzymes are optionally naturally occurring enzymes or artificially evolved enzymes. For example, the biosynthesis of p-aminophenylalanine (as presented in an example in WO 2002/085923 entitled "In vivo incorporation of unnatural amino acids") relies on the addition of a combination of known enzymes from other organisms. The genes for these enzymes can be introduced into a eukaryotic cell by transforming the cell with a plasmid comprising the genes. The genes, when expressed in the cell, provide an enzymatic pathway to synthesize the desired compound. Examples of the types of enzymes that are optionally added are provided in the examples below. Additional enzymes sequences are found, for example, in GenBank. Artificially evolved enzymes are also optionally added into a cell in the same manner. In this manner, the cellular machinery and resources of a cell are manipulated to produce unnatural amino acids.

A variety of methods are available for producing novel enzymes for use in biosynthetic pathways or for evolution of existing pathways. For example, recursive recombination, including but not limited to, as developed by Maxygen, Inc. (available on the World Wide Web at maxygen.com), is optionally used to develop novel enzymes and pathways. See, e.g., Stemmer (1994), *Rapid evolution of a protein in vitro by DNA shuffling, Nature* 370(4):389-391; and, Stemmer, (1994), *DNA shuffling by random fragmentation and reassembly: In vitro recombination for molecular evolution, Proc. Natl. Acad. Sci. USA.,* 91:10747-10751. Similarly DesignPath™, developed by Genencor (available on the World Wide Web at genencor.com) is optionally used for metabolic pathway engineering, including but not limited to, to engineer a pathway to create O-methyl-L-tyrosine in a cell. This technology reconstructs existing pathways in host organisms using a combination of new genes, including but not limited to, those identified through functional genomics, and molecular evolution and design. Diversa Corporation (available on the World Wide Web at diversa.com) also provides technology for rapidly screening libraries of genes and gene pathways, including but not limited to, to create new pathways.

Typically, the unnatural amino acid produced with an engineered biosynthetic pathway of the disclosure is produced in a concentration sufficient for efficient protein biosynthesis, including but not limited to, a natural cellular amount, but not to such a degree as to affect the concentration of the other amino acids or exhaust cellular resources. Typical concentrations produced in vivo in this manner are about 10 mM to about 0.05 mM. Once a cell is transformed with a plasmid comprising the genes used to produce enzymes desired for a specific pathway and an unnatural amino acid is generated, in vivo selections are optionally used to further optimize the production of the unnatural amino acid for both ribosomal protein synthesis and cell growth.

V. In Vivo Generation of Modified FGF-21 Polypeptides Comprising Non-Naturally-Encoded Amino Acids The modified FGF-21 polypeptides of the disclosure can be generated in vivo using modified tRNA and tRNA synthetases to add to or substitute amino acids that are not encoded in naturally-occurring systems. Such methods are described in U.S. Pat. No. 8,012,931, which is incorporated herein by reference in its entirety.

Methods for generating tRNAs and tRNA synthetases which use amino acids that are not encoded in naturally-occurring systems are described in, e.g., U.S. Pat. Nos. 7,045,337 and 7,083,970 which are incorporated by reference herein. These methods involve generating a translational machinery that functions independently of the synthetases and tRNAs endogenous to the translation system (and are therefore sometimes referred to as "orthogonal"). Typically, the translation system comprises an orthogonal tRNA (O-tRNA) and an orthogonal aminoacyl tRNA synthetase (O-RS). Typically, the O-RS preferentially aminoacylates the O-tRNA with at least one non-naturally occurring amino acid in the translation system and the O-tRNA recognizes at least one selector codon that is not recognized by other tRNAs in the system. The translation system thus inserts the non-naturally-encoded amino acid into a protein produced in the system, in response to an encoded selector codon, thereby "substituting" an amino acid into a position in the encoded polypeptide.

Use of O-tRNA/aminoacyl-tRNA synthetases involves selection of a specific codon which encodes the non-naturally encoded amino acid. While any codon can be used, it is generally desirable to select a codon that is rarely or never used in the cell in which the O-tRNA/aminoacyl-tRNA synthetase is expressed. For example, exemplary codons include nonsense codon such as stop codons (amber, ochre, and opal), four or more base codons and other natural three-base codons that are rarely or unused.

Specific selector codon(s) can be introduced into appropriate positions in the modified FGF-21 polynucleotide coding sequence using mutagenesis methods known in the art (including but not limited to, site-specific mutagenesis, cassette mutagenesis, restriction selection mutagenesis, etc.).

VI. Location of Non-Naturally Encoded Amino Acids in Modified FGF-21 Polypeptides The present disclosure contemplates incorporation of one or more non-naturally encoded amino acids into modified FGF-21 polypeptides. One or more non-naturally encoded amino acids may be incorporated at a particular position which does not disrupt activity of the polypeptide. This can be achieved by making "conservative" substitutions, including but not limited to, substituting hydrophobic amino acids with hydrophobic amino acids, bulky amino acids for bulky amino acids, hydrophilic amino acids for hydrophilic amino acids and/or inserting the non-naturally-occurring amino acid in a location that is not required for activity.

In some embodiments, the modified FGF-21 polypeptides of the disclosure comprise one or more non-naturally occurring amino acids positioned in a region of the protein that does not disrupt the structure of the polypeptide.

In some embodiments, the amino acid sequence in the modified FGF-21 polypeptide described herein may comprise at least one non-naturally encoded amino acid. The at least one non-naturally encoded amino acids may be incorporated at any positions in the amino acid sequence, including positions corresponding to amino acids 1-181 from SEQ ID NO: 1 or before position 1 (i.e. at the N-terminus) or at position 182 (i.e., at the carboxyl terminus of the protein) therein or the corresponding amino acids in SEQ ID NOs: 2-7 or another modified FGF-21 polypeptide of the disclosure. In some embodiments, the at least one non-naturally encoded amino acid may be at a position corresponding to amino acid 10, 36, 52, 117, 126, 131, 135, 146, 162, 87, 77, 83, 72, 69, 79, 91, 96, 108, or 110 of SEQ ID NO: 1. In some embodiments, the at least one non-naturally encoded amino acid may be at a position corresponding to amino acid 72, 77, 86, 87, 91, 108, 110, 126, 131, or 146 of SEQ ID NO: 1. In some embodiments, the at least one non-naturally occurring amino acid may be at a position corresponding to amino acid 108 of SEQ ID NO: 1. In some embodiments, the at least one non-naturally encoded amino acid may be a phenylalanine derivative. In some embodiments, the position corresponding to amino acid 108 of SEQ ID NO: 1 may be a phenylalanine derivative. In some embodiments, the at least one non-naturally encoded amino acid may be para-acetyl-L-phenylalanine. In some embodiments, the position corresponding to amino acid 108 of SEQ ID NO: 1 may be para-acetyl-L-phenylalanine. In one embodiment, the non-naturally occurring amino acid is at the 91 position in FGF-21 (SEQ ID NO: 1 or the corresponding amino acids of SEQ ID NOs: 2-7). In one embodiment, the non-naturally occurring amino acid is at the 131 position in FGF-21 (SEQ ID NO: 1 or the corresponding amino acids of SEQ ID NOs: 2-7). In one embodiment, the non-naturally occurring amino acid is at the 108 position in FGF-21 (SEQ ID NO: 1 or the corresponding amino acids of SEQ ID NOs: 2-7). In one embodiment, the non-naturally occurring amino acid is at the 77 position in FGF-21 (SEQ ID NO: 1 or the corresponding amino acids of SEQ ID NOs: 2-7). In one embodiment, the non-naturally occurring amino acid is at the 72 position in FGF-21 (SEQ ID NO: 1 or the corresponding amino acids of SEQ ID NOs: 2-7). In one embodiment, the non-naturally occurring amino acid is at the 87 position in FGF-21 (SEQ ID NO: 1 or the corresponding amino acids of SEQ ID NOs: 2-7). In one embodiment, the non-naturally occurring amino acid is at the 86 position in FGF-21 (SEQ ID NO: 1 or the corresponding amino acids of SEQ ID NOs: 2-7). In one embodiment, the non-naturally occurring amino acid is at the 126 position in FGF-21 (SEQ ID NO: 1 or the corresponding amino acids of SEQ ID NOs: 2-7). In one embodiment, the non-naturally occurring amino acid is at the 110 position in FGF-21 (SEQ ID NO: 1 or the corresponding amino acids of SEQ ID NOs: 2-7). In one embodiment, the non-naturally occurring amino acid is at the 83 position in FGF-21 (SEQ ID NO: 1 or the corresponding amino acids of SEQ ID NOs: 2-7). In one embodiment, the non-naturally occurring amino acid is at the 146 position in FGF-21 (SEQ ID NO: 1 or the corresponding amino acids of SEQ ID NOs: 2-7). In one embodiment, the non-naturally occurring amino acid is at the 135 position in FGF-21 (SEQ ID NO: 1 or the corresponding amino acids of SEQ ID NOs: 2-7). In one embodiment, the non-naturally occurring amino acid is at the 96 position in FGF-21 (SEQ ID NO: 1 or the corresponding amino acids of SEQ ID NOs: 2-7). In one embodiment, the non-naturally occurring amino acid is at the 36 position in FGF-21 (SEQ ID NO: 1 or the corresponding amino acids of SEQ ID NOs: 2-7).

In another embodiment, the amino acid sequence in the modified FGF-21 polypeptide described herein may comprise a non-naturally encoded amino acid at a position corresponding to amino acid 108 of SEQ ID NO: 1 and at least one other non-naturally encoded amino acid at a position corresponding to any other one of amino acids 1-181 from SEQ ID NO: 1 or before position 1 (i.e. at the N-terminus) or at position 182 (i.e., at the carboxyl terminus of the protein) therein or the corresponding amino acids in SEQ ID NOs: 2-7 or another modified FGF-21 polypeptide of the disclosure. In another embodiment, the at least one other non-naturally encoded amino acid may be at a position corresponding to amino acid 10, 36, 52, 117, 126, 131, 135, 146, 162, 87, 77, 83, 72, 69, 79, 91, 96, 108, or 110 of SEQ ID NO: 1. In another embodiment, the at least one other non-naturally encoded amino acid may be at a position corresponding to amino acid 91 or 131 of SEQ ID NO: 1.

In another embodiment, there is a non-naturally occurring amino acid at 91 and one or more other non-naturally occurring amino acids at one or more of the following positions: position corresponding to any other one of amino acids 1-181 from SEQ ID NO: 1 or before position 1 (i.e. at the N-terminus) or at position 182 (i.e., at the carboxyl terminus of the protein) therein or the corresponding amino acids in SEQ ID NOs: 2-7 or another modified FGF-21 polypeptide of the disclosure. In another embodiment, there is a non-naturally occurring amino acid at 91 and one or more other non-naturally occurring amino acid at one or more of the following positions: 131, 108, 77, 72, 87, 86, 126, 110, 83, 146, 135, 96, and 36 (amino acid position corresponding to SEQ ID NO: 1 or the corresponding amino acids of SEQ ID NOs: 2-7).

In another embodiment, there is a non-naturally occurring amino acid at 131 and one other non-naturally occurring amino acid at one or more of the following positions: position corresponding to any other one of amino acids 1-181 from SEQ ID NO: 1 or before position 1 (i.e. at the N-terminus) or at position 182 (i.e., at the carboxyl terminus of the protein) therein or the corresponding amino acids in SEQ ID NOs: 2-7 or another modified FGF-21 polypeptide of the disclosure. In another embodiment, there is a non-naturally occurring amino acid at 131 and one other non-naturally occurring amino acid at one or more of the following positions: 131, 108, 77, 72, 87, 86, 126, 110, 83, 146, 135, 96, and 36 (amino acid position corresponding to SEQ ID NO: 1 or the corresponding amino acids of SEQ ID NOs: 2-7).

In another embodiment, the amino acid sequence in the modified FGF-21 polypeptide described herein may comprise a non-naturally encoded amino acid at a position corresponding to residue 108 of SEQ ID NO: 1 and at least two other non-naturally encoded amino acids at positions corresponding to at least two of the following amino acids of SEQ ID NO: 1: position corresponding to any other one of amino acids 1-181 from SEQ ID NO: 1 or before position 1 (i.e. at the N-terminus) or at position 182 (i.e., at the carboxyl terminus of the protein) therein or the corresponding amino acids in SEQ ID NOs: 2-7 or another modified FGF-21 polypeptide of the disclosure. In another embodiment, the amino acid sequence in the modified FGF-21 polypeptide described herein may comprise a non-naturally encoded amino acid at a position corresponding to amino acid 108 of SEQ ID NO: 1 and at least two other non-naturally occurring amino acids at positions corresponding to at least two of the following amino acids of SEQ ID NO: 1: 10, 36, 52, 117, 126, 131, 135, 146, 162, 87, 77, 83, 72, 69, 79, 91, 96, 108, or 110 of SEQ ID NO: 1.

In another embodiment, there is a non-naturally occurring amino acid at 77 and one other non-naturally occurring amino acid at one or more of the following positions: position corresponding to any other one of amino acids 1-181 from SEQ ID NO: 1 or before position 1 (i.e. at the N-terminus) or at position 182 (i.e., at the carboxyl terminus of the protein) therein or the corresponding amino acids in SEQ ID NOs: 2-7 or another modified FGF-21 polypeptide of the disclosure. In another embodiment, there is a non-naturally occurring amino acid at 77 and one other non-naturally occurring amino acid at one or more of the following positions: 131, 108, 77, 72, 87, 86, 126, 110, 83, 146, 135, 96, and 36 (SEQ ID NO: 1 or the corresponding amino acids of SEQ ID NOs: 2-7).

VII. Expression in Non-Eukaryotes and Eukaryotes

I. Expression Systems, Culture, and Isolation

Unmodified or modified FGF-21 polypeptides may be expressed in any number of suitable expression systems including, for example, yeast, insect cells, mammalian cells, and bacteria. A description of exemplary expression systems is provided below.

Yeast: As used herein, the term "yeast" includes any of the various yeasts capable of expressing a gene encoding a modified FGF-21 polypeptide.

Of particular interest for use with the present disclosure are species within the genera *Pichia, Kluyveromyces, Saccharomyces, Schizosaccharomyces, Hansenula, Torulopsis,* and *Candida*, including, but not limited to, *P. pastoris, P. guillerimondii, S. cerevisiae, S. carlsbergensis, S. diastaticus, S. douglasii, S. kluyveri, S. norbensis, S. oviformis, K. lactis, K fragilis, C. albicans, C. maltosa,* and *H. polymorpha*. WO 2005/091944, which is incorporated by reference, herein describes the expression of FGF-21 in yeast.

Baculovirus-Infected Insect Cells: The term "insect host" or "insect host cell" refers to a insect that can be, or has been, used as a recipient for recombinant vectors or other transfer DNA. The term includes the progeny of the original insect host cell that has been transfected. It is understood that the progeny of a single parental cell may not necessarily be completely identical in morphology or in genomic or total DNA complement to the original parent, due to accidental or deliberate mutation. Progeny of the parental cell that are sufficiently similar to the parent to be characterized by the relevant property, such as the presence of a nucleotide sequence encoding a modified FGF-21 polypeptide, are included in the progeny intended by this definition.

E. Coli, Pseudomonas Species, and Other Prokaryotes:

The term "bacterial host" or "bacterial host cell" refers to a bacterial that can be, or has been, used as a recipient for recombinant vectors or other transfer DNA. The term includes the progeny of the original bacterial host cell that has been transfected. It is understood that the progeny of a single parental cell may not necessarily be completely identical in morphology or in genomic or total DNA complement to the original parent, due to accidental or deliberate mutation. Progeny of the parental cell that are sufficiently similar to the parent to be characterized by the relevant property, such as the presence of a nucleotide sequence encoding an unmodified or modified FGF-21 polypeptide, are included in the progeny intended by this definition.

In selecting bacterial hosts for expression, suitable hosts may include those shown to have, inter alia, good inclusion body formation capacity, low proteolytic activity, and overall robustness. Industrial/pharmaceutical fermentation generally use bacterial derived from K strains (e.g. W3110) or from bacteria derived from B strains (e.g. BL21). Other examples of suitable *E. coli* hosts include, but are not limited to, strains of BL21, DH10B, or derivatives thereof. In another embodiment of the methods of the present disclosure, the *E. coli* host is a protease minus strain including, but not limited to, OMP- and LON-. The host cell strain may be a species of *Pseudomonas*, including but not limited to, *Pseudomonas fluorescens, Pseudomonas aeruginosa,* and *Pseudomonas putida*. *Pseudomonas fluorescens* biovar 1, designated strain MB101, is known to be useful for recombinant production and is available for therapeutic protein production processes.

Once a recombinant host cell strain has been established (i.e., the expression construct has been introduced into the host cell and host cells with the proper expression construct are isolated), the recombinant host cell strain is cultured under conditions appropriate for production of modified FGF-21 polypeptides.

Recombinant host cells may be cultured in batch or continuous formats, with either cell harvesting (in the case where the modified FGF-21 polypeptide accumulates intracellularly) or harvesting of culture supernatant in either batch or continuous formats.

Modified FGF-21 polypeptides produced in bacterial host cells may be poorly soluble or insoluble (in the form of inclusion bodies). In one embodiment of the present disclosure, amino acid substitutions may readily be made in the modified FGF-21 polypeptide that are selected for the purpose of increasing the solubility of the recombinantly produced protein. The modified FGF-21 polypeptide may be solubilized, for example, with urea or guanidine hydrochloride.

In the case of soluble modified FGF-21 protein, the FGF-21 may be secreted into the periplasmic space or into the culture medium. For example, modified FGF-21 is secreted into the periplasmic space of W3110-B2 cells by using plasmids encoding constructs including eight different leader sequences, including those listed in SEQ ID NOs: 39-44, and transforming these into W3110-B2 cells, the cells were then grown at 37° C. until OD reached about 0.8, at which point the expression is induced with 0.01% arabinose. Five hours later the periplasmic release samples can be prepped from the cultures. In addition, soluble modified FGF-21 may be present in the cytoplasm of the host cells. It may be desired to concentrate soluble modified FGF-21 prior to performing purification steps.

When modified FGF-21 polypeptide is produced as a fusion protein, the fusion sequence may be removed. Removal of a fusion sequence may be accomplished by enzymatic or chemical cleavage. Enzymatic removal of fusion sequences may be accomplished using methods known to those of ordinary skill in the art. The choice of enzyme for removal of the fusion sequence may be determined by the identity of the fusion, and the reaction conditions may be specified by the choice of enzyme as will be apparent to one of ordinary skill in the art. Chemical cleavage may be accomplished using reagents known to those of ordinary skill in the art, including but not limited to, cyanogen bromide, TEV protease, and other reagents. The cleaved modified FGF-21 polypeptide may be purified from the cleaved fusion sequence by methods known to those of ordinary skill in the art.

In general, it is occasionally desirable to denature and reduce expressed polypeptides and then to cause the polypeptides to re-fold into the preferred conformation. For example, guanidine, urea, DTT, DTE, and/or a chaperonin can be added to a translation product of interest. The proteins can be refolded in a redox buffer containing, including but not limited to, oxidized glutathione and L-arginine. Refolding reagents can be flowed or otherwise moved into contact with the one or more polypeptide or other expression product, or vice-versa.

In the case of prokaryotic production of modified FGF-21 polypeptide, the modified FGF-21 polypeptide thus produced may be misfolded and thus lacks or has reduced biological activity. The bioactivity of the protein may be restored by "refolding". In general, misfolded unmodified or modified FGF-21 polypeptide is refolded by solubilizing (where the modified FGF-21 polypeptide is also insoluble), unfolding and reducing the polypeptide chain using, for example, one or more chaotropic agents (e.g. urea and/or guanidine) and a reducing agent capable of reducing disulfide bonds (e.g. dithiothreitol, DTT or 2-mercaptoethanol, 2-ME). At a moderate concentration of chaotrope, an oxidizing agent is then added (e.g., oxygen, cystine or cystamine), which allows the reformation of disulfide bonds. Modified FGF-21 polypeptide may be refolded using standard methods known in the art, such as those described in U.S. Pat. Nos. 4,511,502, 4,511,503, and 4,512,922, which are incorporated by reference herein. The modified FGF-21 polypeptide may also be cofolded with other proteins to form heterodimers or heteromultimers.

After refolding, the modified FGF-21 may be further purified. Purification of modified FGF-21 may be accomplished using a variety of techniques known to those of ordinary skill in the art, including hydrophobic interaction chromatography, size exclusion chromatography, ion exchange chromatography, reverse-phase high performance liquid chromatography, affinity chromatography, and the like or any combination thereof. Additional purification may also include a step of drying or precipitation of the purified protein.

After purification, modified FGF-21 may be exchanged into different buffers and/or concentrated by any of a variety of methods known to the art, including, but not limited to, diafiltration and dialysis. Modified FGF-21 that is provided as a single purified protein may be subject to aggregation and precipitation.

The purified modified FGF-21 may be at least 90% pure (as measured by reverse phase high performance liquid chromatography, RP-HPLC, or sodium dodecyl sulfate-polyacrylamide gel electrophoresis, SDS-PAGE) or at least 95% pure, or at least 98% pure, or at least 99% or greater pure. Regardless of the exact numerical value of the purity of the modified FGF-21, the modified FGF-21 is sufficiently pure for use as a pharmaceutical product or for further processing, such as conjugation with a water soluble polymer such as PEG.

Certain modified FGF-21 molecules may be used as therapeutic agents in the absence of other active ingredients or proteins (other than excipients, carriers, and stabilizers, serum albumin and the like), or they may be complexed with another protein or a polymer.

In some embodiments of the present disclosure, the yield of modified FGF-21 after each purification step may be at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, at least about 99.9%, or at least about 99.99%, of the unmodified or modified FGF-21 in the starting material for each purification step.

VIII. Expression in Alternate Systems

Modified FGF-21 polypeptides of the present disclosure may be expressed using a cell-free (e.g., in vitro) translational system. Translation systems may be cellular or cell-free, and may be prokaryotic or eukaryotic. Cellular translation systems include, but are not limited to, whole cell preparations such as permeabilized cells or cell cultures wherein a desired nucleic acid sequence can be transcribed to mRNA and the mRNA translated. Cell-free translation systems are commercially available and many different types and systems are well-known. Examples of cell-free systems include, but are not limited to, prokaryotic lysates such as *Escherichia coli* lysates, and eukaryotic lysates such as wheat germ extracts, insect cell lysates, rabbit reticulocyte lysates, rabbit oocyte lysates and human cell lysates. Membranous extracts, such as the canine pancreatic extracts containing microsomal membranes, are also available which are useful for translating secretory proteins.

IX. Macromolecular Polymers Coupled to Modified FGF-21 Polypeptides

Various modifications to the non-natural amino acid polypeptides described herein can be effected using the compositions, methods, techniques and strategies described herein. These modifications include the incorporation of further functionality onto the non-natural amino acid component of the polypeptide, including but not limited to, a label; a dye; a polymer; a water-soluble polymer; a derivative of polyethylene glycol; a photocrosslinker; a radionuclide; a cytotoxic compound; a drug; an affinity label; a photoaffinity label; a reactive compound; a resin; a second protein or polypeptide or polypeptide analog; an antibody or antibody fragment; a metal chelator; a cofactor; a fatty acid; a carbohydrate; a polynucleotide; a DNA; a RNA; an antisense polynucleotide; a saccharide; a water-soluble dendrimer; a cyclodextrin; an inhibitory ribonucleic acid; a biomaterial; a nanoparticle; a spin label; a fluorophore, a metal-containing moiety; a radioactive moiety; a novel functional group; a group that covalently or noncovalently interacts with other molecules; a photocaged moiety; an actinic radiation excitable moiety; a photoisomerizable moiety; biotin; a derivative of biotin; a biotin analogue; a moiety incorporating a heavy atom; a chemically cleavable group; a photocleavable group; an elongated side chain; a carbon-linked sugar; a redox-active agent; an amino thioacid; a toxic moiety; an isotopically labeled moiety; a biophysical probe; a phosphorescent group; a chemiluminescent group; an electron dense group; a magnetic group; an intercalating group; a chromophore; an energy transfer agent; a biologically active agent; a detectable label; a small molecule; a quantum dot; a nanotransmitter; a radionucleotide; a radiotransmitter; a neutron-capture agent; or any combination of the above, or any other desirable compound or substance. As an illustrative, non-limiting example of the compositions, methods, techniques and strategies described herein, the following description will focus on adding macromolecular polymers to the non-natural amino acid polypeptide with the understanding that the compositions, methods, techniques and strategies described thereto are also applicable (with appropriate modifications, if necessary and for which one of skill in the art could make with the disclosures herein) to adding other functionalities, including but not limited to those listed above.

A wide variety of macromolecular polymers and other molecules can be linked to modified FGF-21 polypeptides of the present disclosure to modulate biological properties of the modified FGF-21 polypeptide, and/or provide new biological properties to the modified FGF-21 molecule. These macromolecular polymers can be linked to the modified FGF-21 polypeptide via a naturally encoded amino acid, via a non-naturally encoded amino acid, or any functional substituent of a natural or non-natural amino acid, or any substituent or functional group added to a natural or non-natural amino acid. The molecular weight of the polymer may be of a wide range, including but not limited to, between about 100 Da and about 100,000 Da or more. The molecular weight of the polymer may be between about 100 Da and about 100,000 Da, including but not limited to, 100,000 Da, 95,000 Da, 90,000 Da, 85,000 Da, 80,000 Da, 75,000 Da, 70,000 Da, 65,000 Da, 60,000 Da, 55,000 Da, 50,000 Da, 45,000 Da, 40,000 Da, 35,000 Da, 30,000 Da, 25,000 Da, 20,000 Da, 15,000 Da, 10,000 Da, 9,000 Da, 8,000 Da, 7,000 Da, 6,000 Da, 5,000 Da, 4,000 Da, 3,000 Da, 2,000 Da, 1,000 Da, 900 Da, 800 Da, 700 Da, 600 Da, 500 Da, 400 Da, 300 Da, 200 Da, and 100 Da. In some embodiments, the molecular weight of the polymer is between about 100 Da and about 50,000 Da. In some embodiments, the molecular weight of the polymer is between about 100 Da and about 40,000 Da. In some embodiments, the molecular weight of the polymer is between about 1,000 Da and about 40,000 Da. In some embodiments, the molecular weight of the polymer is between about 5,000 Da and about 40,000 Da. In some embodiments, the molecular weight of the polymer is between about 10,000 Da and about 40,000 Da.

The polymer selected may be water soluble so that the protein to which it is attached does not precipitate in an aqueous environment, such as a physiological environment. The polymer may be branched or unbranched. For therapeutic use of the end-product preparation, the polymer may be pharmaceutically acceptable.

Examples of polymers include but are not limited to polyalkyl ethers and alkoxy-capped analogs thereof (e.g., polyoxyethylene glycol, polyoxyethylene/propylene glycol, and methoxy or ethoxy-capped analogs thereof, especially polyoxyethylene glycol, the latter is also known as polyethylene glycol or PEG); discrete PEG (dPEG); polyvinylpyrrolidones; polyvinylalkyl ethers; polyoxazolines, polyalkyl oxazolines and polyhydroxyalkyl oxazolines; polyacrylamides, polyalkyl acrylamides, and polyhydroxyalkyl acrylamides (e.g., polyhydroxypropylmethacrylamide and derivatives thereof); polyhydroxyalkyl acrylates; polysialic acids and analogs thereof; hydrophilic peptide sequences; polysaccharides and their derivatives, including dextran and dextran derivatives, e.g., carboxymethyldextran, dextran sulfates, aminodextran; cellulose and its derivatives, e.g., carboxymethyl cellulose, hydroxyalkyl celluloses; chitin and its derivatives, e.g., chitosan, succinyl chitosan, carboxymethylchitin, carboxymethylchitosan; hyaluronic acid and its derivatives; starches; alginates; chondroitin sulfate; albumin; pullulan and carboxymethyl pullulan; polyaminoacids and derivatives thereof, e.g., polyglutamic acids, polylysines, polyaspartic acids, polyaspartamides; maleic anhydride copolymers such as: styrene maleic anhydride copolymer, divinylethyl ether maleic anhydride copolymer; polyvinyl alcohols; copolymers thereof; terpolymers thereof; mixtures thereof; and derivatives of the foregoing.

As used herein, and when contemplating PEG:modified FGF-21 polypeptide conjugates, the term "therapeutically effective amount" refers to an amount which gives the desired benefit to a patient. The amount may vary from one individual to another and may depend upon a number of factors, including the overall physical condition of the patient and the underlying cause of the condition to be treated. The amount of modified FGF-21 polypeptide used for therapy gives an acceptable rate of change and maintains desired response at a beneficial level.

The water soluble polymer may be any structural form including but not limited to linear, forked or branched. Typically, the water soluble polymer is a poly(alkylene glycol), such as poly(ethylene glycol) (PEG), but other water soluble polymers can also be employed. By way of example, PEG is used to describe certain embodiments of this disclosure.

The term "PEG" is used broadly to encompass any polyethylene glycol molecule, without regard to size or to modification at an end of the PEG, and can be represented as linked to the modified FGF-21 polypeptide by the formula:

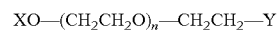

$$XO-(CH_2CH_2O)_n-CH_2CH_2-Y$$

where n is 2 to 10,000 and X is H or a terminal modification, including but not limited to, a $C_{1-4}$ alkyl, a protecting group, or a terminal functional group.

In some cases, a PEG used in the polypeptides of the disclosure terminates on one end with hydroxy or methoxy, i.e., X is H or $CH_3$ ("methoxy PEG"). Alternatively, the PEG can terminate with a reactive group, thereby forming a bifunctional polymer. Typical reactive groups can include those reactive groups that are commonly used to react with the functional groups found in the 20 common amino acids (including but not limited to, maleimide groups, activated carbonates (including but not limited to, p-nitrophenyl ester), activated esters (including but not limited to, N-hydroxysuccinimide, p-nitrophenyl ester) and aldehydes) as well as functional groups that are inert to the 20 common amino acids but that react specifically with complementary functional groups present in non-naturally encoded amino acids (including but not limited to, azide groups, alkyne groups). It is noted that the other end of the PEG, which is shown in the above formula by Y, may attach either directly or indirectly to a modified FGF-21 polypeptide via a naturally-occurring or non-naturally encoded amino acid. For instance, Y may be an amide, carbamate or urea linkage to an amine group (including but not limited to, the epsilon amine of lysine or the N-terminus) of the polypeptide. Alternatively, Y may be a maleimide linkage to a thiol group (including but not limited to, the thiol group of cysteine). Alternatively, Y may be a linkage to a residue not commonly accessible via the 20 common amino acids. For example, an azide group on the PEG can be reacted with an alkyne group on the modified FGF-21 polypeptide to form a Huisgen [3+2] cycloaddition product. Alternatively, an alkyne group on the PEG can be reacted with an azide group present in a non-naturally encoded amino acid to form a similar product. In some embodiments, a strong nucleophile (including but not limited to, hydrazine, hydrazide, hydroxylamine, semicarbazide) can be reacted with an aldehyde or ketone group present in a non-naturally encoded amino acid to form a hydrazone, oxime or semicarbazone, as applicable, which in some cases can be further reduced by treatment with an appropriate reducing agent. Alternatively, the strong nucleophile can be incorporated into the modified FGF-21 polypeptide via a non-naturally encoded amino acid and used to react preferentially with a ketone or aldehyde group present in the water soluble polymer.

Any molecular mass for a PEG can be used as practically desired, including but not limited to, from about 100 Daltons (Da) to 100,000 Da or more as desired (including but not limited to, sometimes 0.1-50 kDa or 10-40 kDa). The molecular weight of PEG may be of a wide range, including but not limited to, between about 100 Da and about 100,000

Da or more. PEG may be between about 100 Da and about 100,000 Da, including but not limited to, 100,000 Da, 95,000 Da, 90,000 Da, 85,000 Da, 80,000 Da, 75,000 Da, 70,000 Da, 65,000 Da, 60,000 Da, 55,000 Da, 50,000 Da, 45,000 Da, 40,000 Da, 35,000 Da, 30,000 Da, 25,000 Da, 20,000 Da, 15,000 Da, 10,000 Da, 9,000 Da, 8,000 Da, 7,000 Da, 6,000 Da, 5,000 Da, 4,000 Da, 3,000 Da, 2,000 Da, 1,000 Da, 900 Da, 800 Da, 700 Da, 600 Da, 500 Da, 400 Da, 300 Da, 200 Da, and 100 Da. Branched chain PEGs, including but not limited to, PEG molecules with each chain having a MW ranging from 1-100 kDa (including but not limited to, 1-50 kDa or 5-20 kDa) can also be used. The molecular weight of each chain of the branched chain PEG may be, including but not limited to, between about 1,000 Da and about 100,000 Da or more. The molecular weight of each chain of the branched chain PEG may be between about 1,000 Da and about 100,000 Da, including but not limited to, 100,000 Da, 95,000 Da, 90,000 Da, 85,000 Da, 80,000 Da, 75,000 Da, 70,000 Da, 65,000 Da, 60,000 Da, 55,000 Da, 50,000 Da, 45,000 Da, 40,000 Da, 35,000 Da, 30,000 Da, 25,000 Da, 20,000 Da, 15,000 Da, 10,000 Da, 9,000 Da, 8,000 Da, 7,000 Da, 6,000 Da, 5,000 Da, 4,000 Da, 3,000 Da, 2,000 Da, and 1,000 Da. Generally, at least one terminus of the PEG molecule is available for reaction with the non-naturally-encoded amino acid. For example, PEG derivatives bearing alkyne and azide moieties for reaction with amino acid side chains can be used to attach PEG to non-naturally encoded amino acids as described herein. If the non-naturally encoded amino acid comprises an azide, then the PEG may typically contain either an alkyne moiety to effect formation of the [3+2] cycloaddition product or an activated PEG species (i.e., ester, carbonate) containing a phosphine group to effect formation of the amide linkage. Alternatively, if the non-naturally encoded amino acid comprises an alkyne, then the PEG may typically contain an azide moiety to effect formation of the [3+2] Huisgen cycloaddition product. If the non-naturally encoded amino acid comprises a carbonyl group, the PEG may typically comprise a potent nucleophile (including but not limited to, a hydrazide, hydrazine, hydroxylamine, or semicarbazide functionality) in order to effect formation of corresponding hydrazone, oxime, and semicarbazone linkages, respectively. In other alternatives, a reverse of the orientation of the reactive groups described above can be used, i.e., an azide moiety in the non-naturally encoded amino acid can be reacted with a PEG derivative containing an alkyne.

In some embodiments, the modified FGF-21 polypeptide with a PEG derivative contains a chemical functionality that is reactive with the chemical functionality present on the side chain of the non-naturally encoded amino acid.

The disclosure provides in some embodiments azide- and acetylene-containing polymer derivatives comprising a water soluble polymer backbone having an average molecular weight from about 800 Da to about 100,000 Da. The polymer backbone of the water-soluble polymer can be poly(ethylene glycol). However, it should be understood that a wide variety of water soluble polymers including but not limited to poly(ethylene)glycol and other related polymers, including poly(dextran) and poly(propylene glycol), are also suitable for use in the presently disclosed polypeptides and that the use of the term PEG or poly(ethylene glycol) is intended to encompass and include all such molecules.

The polymer backbone can be linear or branched. Branched polymer backbones are generally known in the art. Typically, a branched polymer has a central branch core moiety and a plurality of linear polymer chains linked to the central branch core. Branched PEG can also be in the form of a forked PEG represented by PEG(-YCHZ$_2$)$_n$, where Y is a linking group and Z is an activated terminal group linked to CH by a chain of atoms of defined length. Yet another branched form, the pendant PEG, has reactive groups, such as carboxyl, along the PEG backbone rather than at the end of PEG chains.

Many other polymers are also suitable for use in the polypeptides of the present disclosure. Examples of suitable polymers include, but are not limited to, other poly(alkylene glycols), such as poly(propylene glycol) ("PPG"), copolymers thereof (including but not limited to copolymers of ethylene glycol and propylene glycol), terpolymers thereof, mixtures thereof, and the like. Although the molecular weight of each chain of the polymer backbone can vary, it is typically in the range of from about 800 Da to about 100,000 Da, often from about 6,000 Da to about 80,000 Da. The molecular weight of each chain of the polymer backbone may be between about 100 Da and about 100,000 Da, including but not limited to, 100,000 Da, 95,000 Da, 90,000 Da, 85,000 Da, 80,000 Da, 75,000 Da, 70,000 Da, 65,000 Da, 60,000 Da, 55,000 Da, 50,000 Da, 45,000 Da, 40,000 Da, 35,000 Da, 30,000 Da, 25,000 Da, 20,000 Da, 15,000 Da, 10,000 Da, 9,000 Da, 8,000 Da, 7,000 Da, 6,000 Da, 5,000 Da, 4,000 Da, 3,000 Da, 2,000 Da, 1,000 Da, 900 Da, 800 Da, 700 Da, 600 Da, 500 Da, 400 Da, 300 Da, 200 Da, and 100 Da.

Water soluble polymers can be linked to the modified FGF-21 polypeptides of the disclosure. The water soluble polymers may be linked via a non-naturally encoded amino acid incorporated in the modified FGF-21 polypeptide or any functional group or substituent of a non-naturally encoded or naturally encoded amino acid, or any functional group or substituent added to a non-naturally encoded or naturally encoded amino acid. Alternatively, the water soluble polymers are linked to a modified FGF-21 polypeptide comprising a non-naturally encoded amino acid via a naturally-occurring amino acid (including but not limited to, cysteine, lysine or the amine group of the N-terminal residue). In some cases, the modified FGF-21 polypeptides of the disclosure comprise 1, 2, 3, 4, 5, 6, 7, 8, 9, 10 non-natural amino acids, wherein one or more non-naturally-encoded amino acid(s) are linked to water soluble polymer(s) (including but not limited to, PEG and/or oligosaccharides). In some cases, the modified FGF-21 polypeptides of the disclosure further comprise 1, 2, 3, 4, 5, 6, 7, 8, 9, 10, or more naturally-encoded amino acid(s) linked to water soluble polymers. In some cases, the modified FGF-21 polypeptides of the disclosure comprise one or more non-naturally encoded amino acid(s) linked to water soluble polymers and one or more naturally-occurring amino acids linked to water soluble polymers. In some embodiments, the water soluble polymers used in the present disclosure enhance the serum half-life of the modified FGF-21 polypeptide relative to a comparator compound such as the FGF-21 polypeptide of SEQ ID NO:1, SEQ ID NO:201, the same FGF-21 polypeptide without said water soluble polymer, or another comparator compound described elsewhere herein.

The number of water soluble polymers linked to a modified FGF-21 polypeptide (i.e., the extent of PEGylation or glycosylation) of the present disclosure can be adjusted to provide an altered (including but not limited to, increased or decreased) pharmacologic, pharmacokinetic or pharmacodynamic characteristic such as in vivo half-life. In some embodiments, the half-life of modified FGF-21 is increased at least about 10, 20, 30, 40, 50, 60, 70, 80, 90 percent, 2-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 35-fold, 40-fold, 50-fold, or at least about 100-fold over an unmodified polypeptide.

PEG Derivatives Containing a Strong Nucleophilic Group (i.e., Hydrazide, Hydrazine, Hydroxylamine or Semicarbazide)

In one embodiment of the present disclosure, a modified FGF-21 polypeptide comprising a carbonyl-containing non-naturally encoded amino acid may be modified with a PEG derivative that contains a terminal hydrazine, hydroxylamine, hydrazide or semicarbazide moiety that is linked directly to the PEG backbone.

The degree and sites at which the water soluble polymer(s) are linked to the modified FGF-21 polypeptide can modulate the binding of the modified FGF-21 polypeptide to the FGF-21 polypeptide receptor. In some embodiments, the linkages may be arranged such that the modified FGF-21 polypeptide binds the FGF-21 polypeptide receptor with a $K_d$ of about 400 nM or lower, with a $K_d$ of 150 nM or lower, and in some cases with a $K_d$ of 100 nM or lower, as measured by an equilibrium binding assay, such as that described in Spencer et al., *J. Biol. Chem.*, 263:7862-7867 (1988) for modified FGF-21.

Methods and chemistry for activation of polymers as well as for conjugation of peptides are described in the literature and are known in the art. Commonly used methods for activation of polymers include, but are not limited to, activation of functional groups with cyanogen bromide, periodate, glutaraldehyde, biepoxides, epichlorohydrin, divinylsulfone, carbodiimide, sulfonyl halides, trichlorotriazine, etc. PEGylation (i.e., addition of any water soluble polymer) of modified FGF-21 polypeptides containing a non-naturally encoded amino acid, such as p-azido-L-phenylalanine, may be carried out by any suitable method, such as those described in U.S. Pat. No. 8,012,931, which is incorporated by reference herein. A water soluble polymer linked to an amino acid of a modified FGF-21 polypeptide of the disclosure can be further derivatized or substituted without limitation.

In another embodiment of the disclosure, a modified FGF-21 polypeptide may be modified with a PEG derivative that contains an azide moiety that may react with an alkyne moiety present on the side chain of the non-naturally encoded amino acid. In general, the PEG derivatives may have an average molecular weight ranging from 1-100 kDa and, in some embodiments, from 10-40 kDa.

In some embodiments, the azide-terminal PEG derivative may have the structure:

$$RO\text{—}(CH_2CH_2O)_n\text{—}O\text{—}(CH_2)_m\text{—}N_3$$

where R is a simple alkyl (methyl, ethyl, propyl, etc.), m is 2-10 and n is 100-1,000 (i.e., average molecular weight is between 5-40 kDa).

In another embodiment, the azide-terminal PEG derivative may have the structure:

$$RO\text{—}(CH_2CH_2O)_n\text{—}O\text{—}(CH_2)_m\text{—}NH\text{—}C(O)\text{—}(CH_2)_p\text{—}N_3$$

where R is a simple alkyl (methyl, ethyl, propyl, etc.), m is 2-10, p is 2-10 and n is 100-1,000 (i.e., average molecular weight is between 5-40 kDa).

In another embodiment of the disclosure, a modified FGF-21 polypeptide comprising a alkyne-containing amino acid may be further modified with a branched PEG derivative that contains a terminal azide moiety, with each chain of the branched PEG having a MW ranging from 10-40 kDa and may be from 5-20 kDa. For instance, in some embodiments, the azide-terminal PEG derivative may have the following structure:

$$[RO\text{—}(CH_2CH_2O)_n\text{—}O\text{—}(CH_2)_2\text{—}NH\text{—}C(O)]_2CH(CH_2)_m\text{—}X\text{—}(CH_2)_pN_3$$

where R is a simple alkyl (methyl, ethyl, propyl, etc.), m is 2-10, p is 2-10, and n is 100-1,000, and X is optionally an O, N, S or carbonyl group (C=O), in each case that can be present or absent.

In another embodiment of the disclosure, a modified FGF-21 polypeptide may be modified with a PEG derivative that contains an alkyne moiety that may react with an azide moiety present on the side chain of the non-naturally encoded amino acid.

In another embodiment of the disclosure, a modified FGF-21 polypeptide may be modified with a PEG derivative that contains an activated functional group (including but not limited to, ester, carbonate) further comprising an aryl phosphine group that may react with an azide moiety present on the side chain of the non-naturally encoded amino acid.

A modified FGF-21 polypeptide may be conjugated to a hydrazide-containing PEG by the following exemplary methods. A modified FGF-21 polypeptide incorporating a carbonyl-containing amino acid (such as pAcF) may be prepared according to the procedure described above. Once modified, a hydrazide-containing PEG having the following structure may be conjugated to the modified FGF-21 polypeptide:

$$R\text{—}PEG(N)\text{—}O\text{—}(CH_2)_2\text{—}NH\text{—}C(O)(CH_2)_n\text{—}X\text{—}NH\text{—}NH_2$$

where, for example, R=methyl, n=2 and N=10,000 MW and X is a carbonyl (C=O) group. The purified modified FGF-21 containing p-acetylphenylalanine is dissolved at between 0.1-10 mg/mL in 25 mM MES (Sigma Chemical, St. Louis, Mo.) pH 6.0, 25 mM Hepes (Sigma Chemical, St. Louis, Mo.) pH 7.0, or in 10 mM Sodium Acetate (Sigma Chemical, St. Louis, Mo.) pH 4.5, is reacted with a 1 to 100-fold excess of hydrazide-containing PEG, and the corresponding hydrazone is reduced in situ by addition of stock 1M NaCNBH$_3$ (Sigma Chemical, St. Louis, Mo.), dissolved in H$_2$O, to a final concentration of 10-50 mM. Reactions are carried out in the dark at 4° C. to RT for 18-24 hours. Reactions are stopped by addition of 1 M Tris (Sigma Chemical, St. Louis, Mo.) at about pH 7.6 to a final Tris concentration of 50 mM or diluted into appropriate buffer for immediate purification.

Introduction of an Alkyne-Containing Amino Acid into a Modified FGF-21 Polypeptide and Derivatization with Mpeg-Azide Modified FGF-21 polypeptides containing an alkyne-containing amino acid may be produced and may be derivatized with mPEG-azide by the following exemplary methods. A selected position may be substituted with the following non-naturally encoded amino acid:

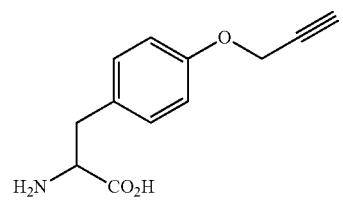 [SMILES: C#CCOc1ccc(CC(N)C(=O)O)cc1]

The sequences utilized for site-specific incorporation of p-propargyl-tyrosine into modified FGF-21 may be SEQ ID NO: 1 (FGF-21), SEQ ID NO: 16 or 17 (muttRNA, *M. jannaschii* mtRNA$_{CUA}^{Tyr}$), 22, 23 or 24 described above. The modified FGF-21 polypeptide containing the propargyl tyrosine may be expressed in *E. coli* and purified using the conditions described above for purification of a modified FGF-21 polypeptide containing a carbonyl-containing amino acid.

The purified modified FGF-21 containing propargyl-tyrosine dissolved at between 0.1-10 mg/mL in PB buffer (100 mM sodium phosphate, 0.15 M NaCl, pH=8) and a 10 to 1000-fold excess of an azide-containing PEG is added to the reaction mixture. A catalytic amount of $CuSO_4$ and Cu wire are then added to the reaction mixture. After the mixture is incubated (including but not limited to, about 4 hours at room temperature or 37° C., or overnight at 4° C.), $H_2O$ is added and the mixture is filtered through a dialysis membrane. The sample can be analyzed to confirm yield.

X. Fusion Proteins Containing Modified FGF-21 Polypeptides

The disclosure also provides modified FGF-21 polypeptides, or a fragments thereof, comprising the modified FGF-21 polypeptide sequence and a fusion partner. The fusion partner may confer a functional property, including but not limited to, half-life extension, facilitating protein purification and/or manufacturing, enhanced biophysical properties such as increase solubility or stability, and reduced immunogenicity or toxicity, or any other purpose. For example, the fusion protein may exhibit extended in vivo half-life, thereby facilitating a less frequent dosing (such as dosing twice per week, once per week, or once every other week, etc.) in a therapeutic regimen. Exemplary fusion proteins comprise a modified FGF-21 fused to a fusion partner such as an albumin (e.g., human serum albumin), PK extending (PKE) adnectin, XTEN, Fc domain, or a fragment of any of the foregoing, or a combination of any of the foregoing. A fusion protein can be produced by expressing a nucleic acid which encodes the modified FGF-21 polypeptide sequence and a fusion partner sequence in the same reading frame, optionally separated by a sequence encoding a connecting peptide. The fusion protein may comprise the modified FGF-21 polypeptide and fusion partner in any order, e.g., one or more fusion partners linked to the N-terminus and/or C-terminus of the modified FGF-21 polypeptide sequence, or one or more fusion partners linked to both the N-terminus and C-terminus.

The fusion may be formed by attaching a fusion partner to either end (i.e., either the N- or C-terminus) of a modified FGF-21 polypeptide, i.e., fusion partner-modified FGF-21 or modified FGF-21-fusion partner arrangements. Additionally, the modified FGF-21 polypeptide may be fused to one or more fusion partners at both ends, optionally with a connecting peptide at either end or both ends. In certain embodiments, the fusion partner and modified FGF-21 are fused via a connecting peptide. Exemplary connecting peptides may comprise or consist of a sequence selected from SEQ ID NOs:74-100, 301, and 350-383, or a combination of the foregoing (e.g., two, three, or more of the foregoing sequences). Exemplary connecting peptides can have lengths of between 0 (i.e., no connecting peptide present) and 100 or more amino acids, such as between at least 1, 2, 3, 4, 5, 6, 7, 8, 9, or 10 and up to 60, 50, 40, 30, 29, 28, 27, 26, 25, 24, 23, 22, 21, 20, 19, 18, 17, 16, 15, 14, 13, 12, or 11 amino acids. Exemplary non-limiting lengths of a connecting peptide include between 1 and 100 amino acids, 1 and 40 amino acids, between 1 and 20 amino acids, between 1 and 10 amino acids, or between 3 and 5 amino acids in length.

A modified FGF-21 polypeptide, or a fragment thereof, can be produced as a fusion protein comprising human serum albumin (HSA) or a portion thereof. Such fusion constructs may be suitable for enhancing expression of the modified FGF-21, or fragment thereof, in a eukaryotic host cell, such as CHO, or in a bacterium such as E. coli. Exemplary HSA portions include the N-terminal polypeptide (amino acids 1-369, 1-419, and intermediate lengths starting with amino acid 1), as disclosed in U.S. Pat. No. 5,766,883, and PCT publication WO 97/24445, which is incorporated by reference herein. In some embodiments, the fusion protein may comprise a HSA protein with a modified FGF-21, or fragments thereof, attached to each of the C-terminal and N-terminal ends of the HSA. Exemplary HSA constructs are disclosed in U.S. Pat. No. 5,876,969, which is incorporated by reference herein. Exemplary methods of mammalian cell expression of FGF-21 are described in WO 2005/091944 which is incorporated by reference herein.

The modified FGF-21 polypeptide may be fused an XTEN molecule. XTEN molecules are also referred to as unstructured recombinant polymers, unstructured recombinant polypeptides (URPs), and are generally described in Schellenberger et al., Nat Biotechnol., 2009 December; 27(12):1186-90, U.S. Pub. No. 2012/0220011, U.S. Pat. No. 7,846,445, and WO/2012/162542, each of which is hereby incorporated by reference in its entirety. The half-life of the modified FGF-21 polypeptide may be varied by varying the constitution of the XTEN molecule, e.g., by varying its size. For example, an XTEN molecule may be selected in order to achieve a desired half-life, such as in the range of 1 to 50 hours, such as at least 1, 2, 5, 10, 12, 15, 20, or 25 hours, or longer.

Exemplary XTEN molecules include a URP comprising at least 40 contiguous amino acids, wherein: (a) the URP comprises at least three different types of amino acids selected from the group consisting of glycine (G), aspartate (D), alanine (A), serine (S), threonine (T), glutamate (E) and proline (P) residues, wherein the sum of said group of amino acids contained in the URP constitutes more than about 80% of the total amino acids of the URP, and wherein said URP comprises more than one proline residue, and wherein said URP possesses reduced sensitivity to proteolytic degradation relative to a corresponding URP lacking said more than one proline residue; (b) at least 50% of the amino acids of said URP are devoid of secondary structure as determined by Chou-Farman algorithm; and (c) the Tepitope score of said URP is less than −5. Additional exemplary XTEN molecules comprise an unstructured recombinant polymer (URP) comprising at least about 40 contiguous amino acids, and wherein (a) the sum of glycine (G), aspartate (D), alanine (A), serine (S), threonine (T), glutamate (E) and proline (P) residues contained in the URP, constitutes at least 80% of the total amino acids of the URP, and the remainder, when present, consists of arginine or lysine, and the remainder does not contain methionine, cysteine, asparagine, and glutamine, wherein said URP comprises at least three different types of amino acids selected from glycine (G), aspartate (D), alanine (A), serine (S), threonine (T), glutamate (E) and proline (P); (b) at least 50% of the at least 40 contiguous amino acids in said URP are devoid of secondary structure as determined by Chou-Fasman algorithm; and (c) wherein the URP has a Tepitope score less than −4.

Additional exemplary XTEN molecules include rPEG molecules. In some embodiments, the rPEG molecule may not include a hydrophobic residue (e.g., F, I, L, M, V, W or Y), a side chain amide-containing residue (e.g., N or Q) or a positively charged side chain residue (e.g., H, K or R). In some embodiments, the enhancing moiety may include A, E, G, P, S or T. In some embodiments, the rPEG may include glycine at 10-20%, 20-30%, 30-40%, 40-50%, 50-60%, 60-70%, 70-80%, 80-90%, 90-99%, or even glycine at 100%.

Said XTEN molecule may be further linked to a polyethylene glycol.

The term "PAS" and/or "PASylation" refers to the genetic fusion of a biopharmaceutical protein of interest such as the modified FGF-21 polypeptide with a conformationally disordered polypeptide sequence composed of the amino acids Pro, Ala and Ser (hence the term "PAS polypeptide" and "PASylation"). PASylation may increase the serum-half life, increased solubility, stability, and/or resistance to protease, and/or decreased immunogenicity of the protein of interest, e.g. the fusion protein (for reference, see WO2008155134 A1 and US20140073563, which are incorporated herein by reference). The PAS sequences may be attached via gene fusion to either the N-terminus, the C-terminus or to both termini of the amino acid sequence of the modified FGF-21 polypeptide. In some embodiments, a PAS polypeptide may comprise at least two domains comprises an amino acid sequence consisting of at least about 100, 150, 200, 250, 300, 350, 400, 450, 500, 600, 700, 800, 900, 1000, or more amino acid residues forming random coil conformation and wherein said second domain comprising alanine, serine and proline residues, whereby said random coil conformation mediates an increased in vivo and/or in vitro stability of the biopharmaceutical protein to which the PAS polypeptide is fused. In some embodiments, the second domain comprising alanine, serine and proline residues may be selected from ASPAAPAPASPAAPAPSAPA (SEQ ID NO: 310); AAPASPAPAAPSAPAPAAPS (SEQ ID NO: 311); APSSPSPSAPSSPSPASPSS (SEQ ID NO: 312), SAPSSPSPSAPSSPSPASPS (SEQ ID NO: 313), SSPSAPSPSSPASPSPSSPA (SEQ ID NO: 314), AASPAAPSAPPAAASPAAPSAPPA NO: 315) and ASAAAPAAASAAASAPSAAA (SEQ ID NO: 316). The PAS polypeptide may contain one or more site(s) for covalent modification.

In exemplary embodiments the modified FGF-21 is fused to an adnectin, e.g. an albumin-binding or PKE adnectin. Exemplary adnectins are disclosed in U.S. Pub. No. 2011/0305663, which is hereby incorporated by reference in its entirety. Said adnectin may be based on a tenth fibronectin type III domain and may bind to serum albumin. Said adnectin may comprise one or more of a BC loop comprising the amino acid sequence set forth in SEQ ID NO: 45, a DE loop comprising the amino acid sequence set forth in SEQ ID NO: 46, and an FG loop comprising the amino acid sequence set forth in SEQ ID NO: 47, or comprises a polypeptide selected from SEQ ID NO: 48, 49, 50, 51, and 52-72, or comprises a polypeptide at least 60%, at least 70%, at least 75%, at least 80%, at least 85%, at least 90% or at least 95% identical to SEQ ID NO: 48, 49, 50, 51, or 52-72, which respectively correspond to SEQ ID NOS 5, 6, 7, 8, 12, 16, 20, and 24-44 of U.S. Pub. No. 2011/0305663.

In some embodiments, the modified FGF-21 polypeptide may be fused to an immunoglobulin Fc domain ("Fc domain"), or a fragment or variant thereof, such as a functional Fc region. A functional Fc region binds to FcRn, but does not possess effector function. The ability of the Fc region or fragment thereof to bind to FcRn can be determined by standard binding assays known in the art. Exemplary "effector functions" include C1q binding; complement dependent cytotoxicity (CDC); Fc receptor binding; antibody-dependent cell-mediated cytotoxicity (ADCC); phagocytosis; down regulation of cell surface receptors (e.g., B cell receptor; BCR), etc. Such effector functions can be assessed using various assays known in the art for evaluating such antibody effector functions.

In an exemplary embodiment, the Fc domain is derived from an IgG1 subclass, however, other subclasses (e.g., IgG2, IgG3, and IgG4) may also be used. Shown below is an exemplary sequence of a human IgG1 immunoglobulin Fc domain:

```
                                        (SEQ ID NO:  302)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNHYTQKSLSLSPGK
```

In some embodiments, the Fc region used in the fusion protein may comprise the hinge region of an Fc molecule. An exemplary hinge region comprises the core hinge residues spanning positions 1-16 (i.e., DKTHTCPPCPAPELLG (SEQ ID NO:303)) of the exemplary human IgG1 immunoglobulin Fc domain sequence provided above. In certain embodiments, the fusion protein may adopt a multimeric structure (e.g., dimer) owing, in part, to the cysteine residues at positions 6 and 9 within the hinge region of the exemplary human IgG1 immunoglobulin Fc domain sequence provided above. In other embodiments, the hinge region as used herein, may further include residues derived from the CH1 and CH2 regions that flank the core hinge sequence of the exemplary human IgG1 immunoglobulin Fc domain sequence provided above. In yet other embodiments, the hinge sequence may comprise or consist of GSTHTCPPCPAPELLG (SEQ ID NO:304).

In some embodiments, the hinge sequence may include one or more substitutions that confer desirable pharmacokinetic, biophysical, and/or biological properties. Some exemplary hinge sequences include EPKSSDKTHTCPPCPAPELLGGPS (SEQ ID NO:305), EPKSSDKTHTCPPCPAPELLGGSS (SEQ ID NO:306), EPKSSGSTHTCPPCPAPELLGGSS (SEQ ID NO:307), DKTHTCPPCPAPELLGGPS (SEQ ID NO:308), and DKTHTCPPCPAPELLGGSS (SEQ ID NO:309). In one embodiment, the residue P at position 18 of the exemplary human IgG1 immunoglobulin Fc domain sequence provided above may be replaced with S to ablate Fc effector function; this replacement is exemplified in hinges having the sequences EPKSSDKTHTCPPCPAPELLGGSS (SEQ ID NO:306), EPKSSGSTHTCPPCPAPELLGGSS (SEQ ID NO:307), and DKTHTCPPCPAPELLGGSS (SEQ ID NO:309). In another embodiment, the residues DK at positions 1-2 of the exemplary human IgG1 immunoglobulin Fc domain sequence provided above may be replaced with GS to remove a potential clip site; this replacement is exemplified in the sequence EPKSSGSTHTCPPCPAPELLGGSS (SEQ ID NO:307). In another embodiment, the C at the position 103 of the heavy chain constant region of human IgG1 (i.e., domains $CH_1$-$CH_3$), may be replaced with S to prevent improper cysteine bond formation in the absence of a light chain; this replacement is exemplified in the sequences EPKSSDKTHTCPPCPAPELLGGPS (SEQ ID NO:305), EPKSSDKTHTCPPCPAPELLGGSS (SEQ ID NO:306), and EPKSSGSTHTCPPCPAPELLGGSS (SEQ ID NO:307).

Additional exemplary Fc sequences include the following:

hIgG1a_191 [A subtype]
(SEQ ID NO: 323)
DKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1a_189 [hIgG1a_191 sans "GK" on C term;
A subtype]
(SEQ ID NO: 324)
DKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSP hIgG1a_191b [A/F subtype]
(SEQ ID NO: 325)
DKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALPAPIEKTISKAKGQPREPQVYTLPPSRDEMTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1f_1.1_191 [Contains 5 point mutations to alter ADCC function, F subtype]
(SEQ ID NO: 326)
DKTHTCPPCPAPEAEGAPSVFLFPPKPKDTLMISRTPEVTCVVVDVSHED
PEVKFNWYVDGVEVHNAKTKPREEQYNSTYRVVSVLTVLHQDWLNGKEYK
CKVSNKALPSSIEKTISKAKGQPREPQVYTLPPSREEMTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1f_1.1_186 [Contains 5 point mutations to alter ADCC function and C225S (Edlemen numbering); F subtype]
(SEQ ID NO: 327)
EPKSSDKTHTCPPCPAPEAEGAPSVFLFPPKPKDTLMISRTPEVTCVVVD
VSHEDPEVKFNWYVDGVEVHNAKTKPREEQYNSTYRVVSVLTVLHQDWLN
GKEYKCKVSNKALPSSIEKTISKAKGQPREPQVYTLPPSREEMTKNQVSL
TCLVKGFYPSDIAVEWESNGQPENNYKTTPPVLDSDGSFFLYSKLTVDKS
RWQQGNVFSCSVMHEALHNHYTQKSLSLSPGK hIgG1a_(N297G)_191 [A subtype]
(SEQ ID NO: 328)
DKTHTCPPCPAPELLGGPSVFLFPPKPKDTLMISRTPEVTCVVVDVSHED
PEVKFNWYVDGVEVHNAKTKPREEQYGSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1a_190 [hIgG1a_190 sans "K" on C term;
A subtype]
(SEQ ID NO: 329)
DKTHTCPPCPAPELLGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPG hIgG1a_(N297Q)_191 [A subtype]
(SEQ ID NO: 330)
DKTHTCPPCPAPELLGGPSVFLFPPKPKDTLMISRTPEVTCVVVDVSHED
PEVKFNWYVDGVEVHNAKTKPREEQYQSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1a_(N297S)_191 [A subtype]
(SEQ ID NO: 331)
DKTHTCPPCPAPELLGGPSVFLFPPKPKDTLMISRTPEVTCVVVDVSHED
PEVKFNWYVDGVEVHNAKTKPREEQYSSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1a_(N297A)_191 [A subtype]
(SEQ ID NO: 332)
DKTHTCPPCPAPELLGGPSVFLFPPKPKDTLMISRTPEVTCVVVDVSHED
PEVKFNWYVDGVEVHNAKTKPREEQYASTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG1a_(N297H)_191 [A subtype]
(SEQ ID NO: 333)
DKTHTCPPCPAPELLGGPSVFLFPPKPKDTLMISRTPEVTCVVVDVSHED
PEVKFNWYVDGVEVHNAKTKPREEQYHSTYRVVSVLTVLHQDWLNGKEYK
CKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQG
NVFSCSVMHEALHNHYTQKSLSLSPGK hIgG4
(SEQ ID NO: 334)
DKRVESKYGPPCPSCPAPEFLGGPSVFLFPPKPKDTLMISRTPEVTCVVV
DVSQEDPEVQFNWYVDGVEVHNAKTKPREEQFNSTYRVVSVLTVLHQDWL
NGKEYKCKVSNKGLPSSIEKTISKAKGQPREPQVYTLPPSQEEMTKNQVS
LTCLVKGFYPSDIAVEWESNGQPENNYKTTPPVLDSDGSFFLYSRLTVDK
SRWQEGNVFSCSVMHEALHNHYTQKSLSLSLGK hIgG4_(S241P)
(SEQ ID NO: 335)
DKRVESKYGPPCPPCPAPEFLGGPSVFLFPPKPKDTLMISRTPEVTCVVV
DVSQEDPEVQFNWYVDGVEVHNAKTKPREEQFNSTYRVVSVLTVLHQDWL
NGKEYKCKVSNKGLPSSIEKTISKAKGQPREPQVYTLPPSQEEMTKNQVS -continued
LTCLVKGFYPSDIAVEWESNGQPENNYKTTPPVLDSDGSFFLYSRLTVDK

SRWQEGNVFSCSVMHEALHNHYTQKSLSLSLGK

In some embodiments, the Fc domain comprises an amino acid sequence selected from SEQ ID NOs: 302 and 323-335. It should be understood that the C-terminal lysine of an Fc domain is an optional component of a fusion protein comprising an Fc domain. In some embodiments, the Fc domain comprises an amino acid sequence selected from SEQ ID NOs: 302 and 323-335, except that the C-terminal lysine thereof is omitted. In some embodiments, the Fc domain comprises the amino acid sequence of SEQ ID NO: 302. In some embodiments, the Fc domain comprises the amino acid sequence of SEQ ID NOs: 302 except the C-terminal lysine thereof is omitted.

In some embodiments, the modified FGF-21 polypeptide comprising an albumin binding sequence is made. Exemplary albumin binding sequences include, but are not limited to, the albumin binding domain from streptococcal protein G (see. e.g., Makrides et al., *J. Pharmacol. Exp. Ther.* 277: 534-542 (1996) and Sjolander et al., *J. Immunol. Methods* 201:115-123 (1997)), or albumin-binding peptides such as those described in, e.g., Dennis, et al., *J. Biol. Chem.* 277:35035-35043 (2002).

In some embodiments, the modified FGF-21 polypeptides of the present disclosure are acylated with fatty acids. In some cases, the fatty acids promote binding to serum albumin. See, e.g., Kurtzhals, et al., *Biochem. J.* 312:725-731 (1995).

In some embodiments, the modified FGF-21 polypeptides of the present disclosure are fused directly with serum albumin (including but not limited to, human serum albumin) Those of skill in the art will recognize that a wide variety of other molecules can also be linked to modified FGF-21 in the present disclosure to modulate binding to serum albumin or other serum components.

XI. Glycosylation of Modified and Unmodified FGF-21 Polypeptides

The present disclosure includes modified FGF-21 polypeptides comprising one or more non-naturally encoded amino acids bearing saccharide residues. The saccharide residues may be either natural (including but not limited to, N-acetylglucosamine) or non-natural (including but not limited to, 3-fluorogalactose). The saccharides may be linked to the non-naturally encoded amino acids either by an N- or O-linked glycosidic linkage (including but not limited to, N-acetylgalactose-L-serine) or a non-natural linkage (including but not limited to, an oxime or the corresponding C- or S-linked glycoside).

The saccharide (including but not limited to, glycosyl) moieties can be added to modified FGF-21 polypeptides either in vivo or in vitro. In some embodiments of the present disclosure, a modified FGF-21 polypeptide comprising a carbonyl-containing non-naturally encoded amino acid may be modified with a saccharide derivatized with an aminooxy group to generate the corresponding glycosylated polypeptide linked via an oxime linkage. Once attached to the non-naturally encoded amino acid, the saccharide may be further elaborated by treatment with glycosyltransferases and other enzymes to generate an oligosaccharide bound to the modified FGF-21 polypeptide. See, e.g., H. Liu, et al. *J. Am. Chem. Soc.* 125: 1702-1703 (2003).

In some embodiments of the present disclosure, a modified FGF-21 polypeptide comprising a carbonyl-containing non-naturally encoded amino acid may be modified directly with a glycan with defined structure prepared as an aminooxy derivative. Other functionalities, including azide, alkyne, hydrazide, hydrazine, and semicarbazide, can be used to link the saccharide to the non-naturally encoded amino acid.

In some embodiments of the present disclosure, a modified FGF-21 polypeptide comprising an azide or alkynyl-containing non-naturally encoded amino acid can then be modified by, including but not limited to, a Huisgen [3+2] cycloaddition reaction with, including but not limited to, alkynyl or azide derivatives, respectively.

XII. FGF-21 Dimers and Multimers

The present disclosure also provides for FGF-21 and modified FGF-21 combinations such as homodimers, heterodimers, homomultimers, or heteromultimers (i.e., trimers, tetramers, etc.) where modified FGF-21 containing one or more non-naturally encoded amino acids is bound to another FGF-21 or modified FGF-21 or a variant thereof or any other polypeptide that is not FGF-21 or modified FGF-21 or a variant thereof, either directly to the polypeptide backbone or via a linker. Due to its increased molecular weight compared to monomers, the FGF-21 dimer or multimer conjugates may exhibit new or desirable properties, including but not limited to different pharmacological, pharmacokinetic, pharmacodynamic, modulated therapeutic half-life, or modulated plasma half-life relative to the monomeric FGF-21. In some embodiments, modified FGF-21 dimers of the present disclosure may modulate signal transduction of the FGF-21 receptor. In other embodiments, the modified FGF-21 dimers or multimers of the present disclosure may act as a FGF-21 receptor antagonist, agonist, or modulator.

XIII. Measurement of FGF-21 Polypeptide Activity and Affinity of FGF-21 Polypeptide for the FGF-21 Polypeptide Receptor FGF-21 has been shown to stimulate glucose uptake and enhance insulin sensitivity in 3T3-L1 adipocytes, an in vitro model utilized for the study of adipose tissue metabolism as shown in Example 3 of U.S. Patent Publication No. 20040259780 which is incorporated by reference in its entirety. A characteristic of Type 2 diabetes is the deficiency of glucose uptake in various tissue types including adipose tissue. Thus, modified FGF-21 may be useful for treating Type 2 diabetes by lowering blood glucose levels. Moreover, modified FGF-21 may be useful for treating obesity by increasing energy expenditure by faster and more efficient glucose utilization. Additionally, FGF-21 has been shown to stimulate glucose uptake in 3T3-L1 adipocytes in an insulin independent manner, indicating that it is useful for treating Type 1 diabetes as well. See U.S. Patent Publication No. 20040259780. FGF-21 is shown to stimulate glucose uptake in 3T3-L1 adipocytes in a concentration dependent manner at a sub-optimal concentration of insulin (5 nM) and in the absence of insulin in U.S. Patent Publication No. 20040259780. Additionally, FGF-21 induces glucose uptake in an ex vivo tissue model, described in U.S. Patent Publication No. 20040259780.

The modified FGF-21 polypeptides may be subject to assays for biological activity. In general, the test for biological activity should provide analysis for the desired result, such as increase or decrease in biological activity, different biological activity, receptor or binding partner affinity analysis, conformational or structural changes of the modified FGF-21 itself or its receptor, or serum half-life analysis, as compared to unmodified FGF-21 or another comparator compound as described elsewhere herein.

Exemplary methods for differentiation of 3T3-L1 to adipocytes and glucose uptake assay are described in U.S. Pat. No. 8,012,931, which is incorporated herein by reference in its entirety.

XIV. Measurement of Potency, Functional In Vivo Half-Life, and Pharmacokinetic Parameters An aspect of the present disclosure is the prolonged biological half-life that can be obtained by construction of the modified FGF-21 polypeptide, which may be conjugated to a water soluble polymer moiety, or fused to a fusion partner. The rapid post administration decrease of FGF-21 polypeptide serum concentrations has made it therapeutically significant to evaluate biological responses to treatment with the modified FGF-21 polypeptide. The modified FGF-21 polypeptide of the present disclosure may have prolonged serum half-lives also after administration via, e.g. subcutaneous or i.v. administration, making it possible to measure by, e.g. ELISA method or by a primary screening assay. Measurement of in vivo biological half-life is carried out as described herein.

The potency and functional in vivo half-life of the modified FGF-21 polypeptide comprising an internal deletion and/or non-naturally encoded amino acid may be determined according to protocols known to those of ordinary skill in the art and as described herein.

In an exemplary assay, pharmacokinetic parameters for a unmodified or modified FGF-21 polypeptide described herein can be evaluated in normal Sprague-Dawley male rats (N=5 animals per treatment group). Animals may receive either a single dose of 25 ug/rat iv or 50 ug/rat sc, and approximately 5-7 blood samples may be taken according to a pre-defined time course, generally covering about 6 hours for a modified FGF-21 polypeptide comprising a non-naturally encoded amino acid not conjugated to a water soluble polymer and about 4 days for a modified FGF-21 polypeptide comprising a non-naturally encoded amino acid and conjugated to a water soluble polymer. Pharmacokinetic data for a modified FGF-21 can be compared to a comparator compound such as a wild-type FGF-21 polypeptide of SEQ ID NO:1, the modified FGF-21 polypeptide of SEQ ID NO:201, the same modified FGF-21 polypeptide lacking an internal deletion, or another comparator compound described herein.

Pharmacokinetic parameters can also be evaluated in a primate, e.g., cynomolgus monkeys. Typically, a single injection is administered either subcutaneously or intravenously, and serum FGF-21 levels are monitored over time.

Polypeptides of the present disclosure may be used to treat mammals suffering from non-insulin dependent Diabetes Mellitus (NIDDM: Type 2), insulin dependent diabetes (Type 1), as well as obesity, inadequate glucose clearance, hyperglycemia, hyperinsulinemia, and the like. FGF-21 is effective in animal models of diabetes and obesity, as shown in U.S. Patent Publication No. 20040259780, which is incorporated by reference herein in its entirety. As metabolic profiles differ among various animal models of obesity and diabetes, analysis of multiple models have been undertaken to separate the effects of hyperinsulinemia, hyperglycemia and obesity. The diabetes (db/db) and obese (ob/ob) mice are characterized by massive obesity, hyperphagia, variable hyperglycemia, insulin resistance, hyperinsulinemia and impaired thermogenesis (Coleman, Diabetes 31:1, 1982; E. Shafrir, in Diabetes Mellitus; H. Rifkin and D. Porte, Jr. Eds. (Elsevier Science Publishing Co., Inc., New York, ed. 4, 1990), pp. 299-340). However, diabetes is much more severe in the db/db model (Coleman, Diabetes 31:1, 1982; E. Shafrir, in Diabetes Mellitus; H. Rifkin and D. Porte, Jr. Eds. (Elsevier Science Publishing Co., Inc., New York, ed. 4, 1990), pp. 299-340). Zucker (fa/fa) rats are severely obese, hyperinsulinemic, and insulin resistant (Coleman, Diabetes 31:1, 1982; E. Shafrir, in Diabetes Mellitus; H. Rifkin and D. Porte, Jr. Eds. (Elsevier Science Publishing Co., Inc., New York, ed. 4, 1990), pp. 299-340), and the fa/fa mutation may be the rat equivalent of the murine db mutation (Friedman et al., Cell 69:217-220, 1992; Truett et al., Proc. Natl. Acad. Sci. USA 88:7806, 1991). Tubby (tub/tub) mice are characterized by obesity, moderate insulin resistance and hyperinsulinemia without significant hyperglycemia (Coleman et al., J. Heredity 81:424, 1990).

The monosodium glutamate (MSG) model for chemically-induced obesity (Olney, Science 164:719, 1969; Cameron et al., Cli. Exp. Pharmacol. Physiol. 5:41, 1978), in which obesity is less severe than in the genetic models and develops without hyperphagia, hyperinsulinemia and insulin resistance, may also be examined. Finally, the streptozotocin (STZ) model for chemically-induced diabetes may be tested to examine the effects of hyperglycemia in the absence of obesity. STZ-treated animals are deficient in insulin and severely hyperglycemic (Coleman, Diabetes 31:1, 1982; E. Shafrir, in Diabetes Mellitus; H. Rifkin and D. Porte, Jr. Eds. (Elsevier Science Publishing Co., Inc., New York, ed. 4, 1990), pp. 299-340).

Modified FGF-21 polypeptides of the present disclosure can be evaluated in an in vivo septic shock model in ob/ob mice. See U.S. Patent Publication No. 20050176631, which is incorporated by reference in its entirety herein.

Methods for Analysis of ERK1/2 Phosphorylation Induced by FGF-21

ERK1/2 Phosphorylation Induced By FGF-21 (wild-type or modified FGF-21 polypeptides including those linked to a PEG or other linker, polymer, or biologically active molecule) may be carried out by the following exemplary methods:

Seed 293-stably transfected with human Klotho beta at 100,000 cells/well (DMEM+10% FBS) in a poly-Lys coated plate. The following day cells are 100% confluent, media is aspirated off and replaced with fresh media and incubate overnight. After 24 hours cells are stimulated with the selected unmodified or modified FGF-21 or FGF-21 analog using as standard FGF21WT. Each individual compound is prepared by diluting them in PBS/1% BSA. Cells are treated in triplicate for 10 min @ 37° C. in the incubator. After 10 min incubation media is carefully aspirated off from each well and 40 ul of cold 1× Cell Signaling Lysis Buffer containing protease/phosphatase inhibitors (PI cocktail, Na3VN4 and PMSF) are added to each well to produce cell lysates. 96 well/plate is placed on ice for 20 minutes and then spun down at 4000 rpm for 10 min. Cell lysates are frozen down at −80° C. Later on each sample is thawed out and 10 ul of cell lysates is added to MSD treated plate coated with antibody capturing both the unphosphorylated and phosphorylated forms of ERK1/2. Incubation with primary antibody occurs for 2 hrs, then the plate is washed several times with specific buffer followed by addition of secondary antibody. After 1 hour the incubation plate is washed again several times. Buffer for reading is added to each well. The plate is transferred to MSD reading machine. The curve that is produced is based on the anti-phosphorylated ERK1/2 reading units and EC50 is calculated using Sigma Plot. The fold loss of activity is calculated by dividing EC50 of the tested compound with the EC50 of the WT.

Determination of Pharmacokinetic Properties of Modified FGF-21 Polypeptides in Rats These exemplary methods may be used to measure the pharmacokinetic properties of native and modified FGF-21 compounds in catheterized rats. The pharmacokinetics of test articles are assayed by ELISA specific for human FGF-21 from serum samples obtained at specific time points after drug dosing.

Twelve (12) male Sprague-Dawley (SD) rats weighing approximately 250-275 grams at study initiation may have had jugular vein catheters surgically placed. Animals are in good condition and may have acclimated to the study location for at least 3 days prior to the start of the study. Rats may be weighed on the day of test article administration. Animals may be housed in standard, pathogen-free conditions with food and water ad libitum.

Compounds are administered subcutaneously, for example at 0.25 mg/kg.

Animals are weighed prior to administration of test article. Compounds are formulated so as to be administered at 1×BW in μL. Subcutaneous administration of test article is injected into the dorsal scapular region. Animals may receive a single injection of test article (time=0). At selected time points, whole blood may be drawn from the animals, collected into SST microtainer collection tubes. Serum may be allowed to clot for 30 minutes prior to centrifugation. Serum may be transferred to polypropylene titer tubes, sealed with microstrips, and stored at −80 degrees C. until analyzed by ELISA to determine unmodified or modified FGF-21 serum concentrations.

Each animal may be used for a complete PK time course. Approximately 0.25 mL of whole blood may be drawn from the jugular vein catheters Immediately after the blood collection, the catheters may be flushed with 0.1 mL of saline. The following collection time points for animals receiving test article material are required selected but may be modified based on the anticipated pharmacokinetic profile of the test articles:

Pre-bleed, 1, 2, 4, 8, 24, 32 48, 56, 72, and 96 hours post-dose. Pharmacokinetic parameters are determined for each tested compound, which may include Lambda_z, Lambda_z_lower, Lambda_z_upper, HL_Lambda_z, Tmax, Cmax, C0, AUCINF_obs, Vz_obs, Cl_obs, MRTINF_obs, and/or Vss_obs.

In Vivo Studies of Modified FGF-21 in ZDF Rats

Modified FGF-21, unmodified FGF-21, and buffer solution are administered to mice or rats. The results show activity and half life of the modified FGF-21 polypeptides of the present disclosure compared to unmodified FGF-21.

WO 2005/091944 describes pharmacokinetic studies that can be performed with FGF-21 compounds, such as the compounds of the present disclosure. A modified FGF-21 polypeptide of the present disclosure is administered by intravenous or subcutaneous routes to mice. The animals are bled prior to and at time points after dosing. Plasma is collected from each sample and analyzed by radioimmunoassay. Elimination half-life can be calculated and compared between modified FGF-21 polypeptides comprising an internal deletion and/or a non-naturally encoded amino acid or fusion partner, and wild-type FGF-21 or various forms of FGF-21 polypeptides of the present disclosure. Similarly, modified FGF-21 polypeptides of the present disclosure may be administered to cynomolgus monkeys. The animals are bled prior to and at time points after dosing. Plasma is collected from each sample and analyzed by radioimmunoassay.

Polypeptides of the present disclosure may be administered to ZDF male rats (diabetic, fat rats; 8 weeks of age at beginning of study, Charles River-GMI). Rats are fed Purina 5008 feed ad libitum. The following test groups are set up: Saline; Insulin 4 U/day; unmodified or modified FGF-21, 500 ug/day Acute (Acute dosing group is dosed once and bled at T=0, 2, 4, 8, and 24 hours post dose); unmodified or modified FGF-21, 100 ug/day; unmodified or modified FGF-21, 250 ug/day; unmodified or modified FGF-21, 500 ug/day; unmodified or modified FGF-21 (once/day) 500 ug/ml; Lean Saline; Lean Insulin 4 U/day; Lean unmodified or modified FGF-21 500 ug/day. Lean groups represent non-diabetic, lean, ZDF rats.

Compounds are injected s.c. (b.i.d.), except for the second 500 ug/day group which receives one injection per day for the duration of the study (7 days). Control rats are injected with vehicle (PBS; 0.1 ml). Following 7 days of dosing, the animals are subjected to an oral glucose tolerance test. Blood for glucose and triglycerides are collected by tail clip bleeding without anesthetic. Modified FGF-21 polypeptides may reduce plasma glucose levels in a dose-dependent manner. Also lean ZDF rats may not become hypoglycemic after exposure to modified FGF-21 polypeptides of the present disclosure when compared to rats dosed with insulin.

In Vivo Studies of Modified FGF-21 in ob/ob Obesity Model

The ob/ob mouse model is an animal model for hyperglycemia, insulin resistance, and obesity. Plasma glucose levels after treatment with unmodified or modified FGF-21 polypeptide compared to vehicle and insulin control groups may be measured in ob/ob mice. In this obesity model, the test groups of male ob/ob mice (7 weeks old) are injected with vehicle alone (PBS), insulin (4 U/day), or unmodified or modified FGF-21 polypeptide (5 mg/day and 25 mg/day), subcutaneously (0.1 ml, b.i.d) for seven days. Blood is collected by tail clip bleeding on days 1, 3, and 7, one hour after the first compound injection, and plasma glucose levels are measured using a standard protocol. Modified FGF-21 polypeptides of the present disclosure stimulate glucose uptake if they reduce plasma glucose levels when compared to the vehicle control group. Triglyceride levels may be compared after treatment with modified FGF-21 polypeptides of the present disclosure compared to other molecules. The polypeptide may be administered the mice via multiple doses, continuous infusion, or a single dose, etc.

Pharmacokinetic Evaluation of Modified FGF21 Polypeptides:

The pharmacokinetic properties of modified FGF-21 with varying sites of PEG conjugation are evaluated in rat. Other parameters studied are PEG MW, as well as dose of compound administered. The percent bioavailability is determined All animal experimentation is conducted under protocols approved by the Institutional Animal Care and Use Committee. Male (175-300 g) Sprague-Dawley rats are obtained from Charles River Laboratories. Rats are housed individually in cages in rooms with a 12-h light/dark cycle and acclimated to the vivarium for at least 3 days prior to experimentation. Animals are provided access to certified Purina rodent chow 5001 and water ad libitum.

Catheters are surgically installed into the jugular vein for blood collection. Following successful catheter patency, animals are assigned to treatment groups prior to dosing. A single-dose of compound is administered intravenously or subcutaneously in a dose volume of 1 mL/kg. Compound dose concentrations are derived by dilution in PBS using the stock concentration as assigned in the Certificate of Release.

Blood samples are collected at various time points via the indwelling catheter and placed into SST microfuge tubes. Serum is collected after centrifugation, and stored at −80° C. until analysis.

The assay for the quantification of modified FGF-21 in Sprague-Dawley rat serum is performed as follows. Microplate wells are coated with goat anti-human FGF-21 IgG polyclonal antibody (PAb; RnD Systems, clone AF2539) that is used as the capture reagent. Standard (STD) and quality control (QC) samples, both made by spiking unmodified or modified FGF-21 into 100% Sprague Dawley rat serum, and study samples are loaded into the wells after pre-treating 1:100 with I-Block buffer. The unmodified or modified FGF-21 in the STDs, QCs and study samples is captured by the immobilized PAb. Unbound materials are removed by washing the wells. Biotin goat anti-human FGF-21 IgG PAb (RnD Systems, clone BAF2539) is added to the wells followed by a wash step and the addition of streptavidin horseradish peroxidase (SA-HRP; RnD Systems, Catalog #DY998) for detection of the captured unmodified or modified FGF-21. After another washing step, tetramethylbenzidine (TMB, Kirkegaard Perry Laboratories) substrate solution is added to the wells. TMB reacts with the peroxide in the presence of HRP and produces a colorimetric signal proportional to the amount of FGF-21 (wild-type or modified FGF-21) bound by the capture reagent in the initial step. The color development is stopped by the addition of 2N sulfuric acid and the intensity of the color (optical density, OD) is measured at 450 nm. The conversion of OD units for the study samples and the QCs to concentration is achieved through a computer software mediated comparison to a standard curve on the same plate, which is regressed according to a 5-parameter logistic regression model using SOFTmax Pro v5 data reduction package. Results are reported in ng/mL concentration units.

Concentrations may also be measured by a double antibody sandwich assay or other methods known to those skilled in the art. Concentrations are calculated using a standard curve generated from the corresponding dosed compound. Pharmacokinetic parameters are estimated using the modeling program WinNonlin (Pharsight, version 4.1). Noncompartmental analysis for individual animal data with linear-up/log-down trapezoidal integration is used, and concentration data is uniformly weighted.

XV. Administration and Pharmaceutical Compositions

Also provided herein are compositions comprising a therapeutically effective amount of the modified FGF-21 polypeptide, described herein, and a pharmaceutically acceptable carrier or excipient. Such a carrier or excipient includes, but is not limited to, saline, buffered saline, dextrose, water, glycerol, ethanol, and/or combinations thereof. The formulation is made to suit the mode of administration. In general, methods of administering proteins are known to those of ordinary skill in the art and can be applied to administration of the polypeptides of the present disclosure.

For example, a modified FGF-21 polypeptide described herein may be administered to a patient at a concentration of between about 0.1 and 100 mg/kg of body weight of recipient patient. In an embodiment, a modified FGF-21 polypeptide described herein may be administered to a patient at a concentration of about 0.5-5 mg/kg of body weight of recipient patient. In another embodiment, a modified FGF-21 polypeptide described herein may be administered to a recipient patient with a frequency of between once per day and once per two weeks, such as about once or twice per week, once every two days, once every three days, once every four days, once every five days, or once every six days.

It is to be understood that the concentration of the modified FGF-21 polypeptide administered to a given patient may be greater or lower than the exemplary administration concentrations set forth above.

Based upon the information provided in the present disclosure, a person of skill in the art would be able to determine an effective dosage and frequency of administration through routine experimentation, for example guided by the disclosure herein and the teachings in Goodman, L. S., Gilman, A., Brunton, L. L., Lazo, J. S., & Parker, K. L. (2006). Goodman & Gilman's the pharmacological basis of therapeutics. New York: McGraw-Hill; Howland, R. D., Mycek, M. J., Harvey, R. A., Champe, P. C., & Mycek, M. J. (2006). Pharmacology. Lippincott's illustrated reviews. Philadelphia: Lippincott Williams & Wilkins; and Golan, D. E. (2008). Principles of pharmacology: the pathophysiologic basis of drug therapy. Philadelphia, Pa., (etc.): Lippincott Williams & Wilkins.

Average quantities of the modified FGF-21 may vary and in particular should be based upon the recommendations and prescription of a qualified physician. The exact amount of modified FGF-21 is a matter of preference subject to such factors as the exact type of condition being treated, the condition of the patient being treated, as well as the other ingredients in the composition. The present disclosure also provides for administration of a therapeutically effective amount of another active agent. The amount to be given may be readily determined by one of ordinary skill in the art.

A "pharmaceutical composition" refers to a chemical or biological composition suitable for administration to a mammal Such compositions may be specifically formulated for administration via one or more of a number of routes, including but not limited to buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal. In addition, administration can occur by means of injection, powder, liquid, gel, drops, or other means of administration.

As used herein "pharmaceutically acceptable carrier" or "excipient" includes any and all solvents, dispersion media, coatings, antibacterial and antifungal agents, isotonic and absorption delaying agents that are physiologically compatible. In one embodiment, the carrier is suitable for parenteral administration. Alternatively, the carrier can be suitable for intravenous, intraperitoneal, intramuscular, or sublingual administration. Pharmaceutically acceptable carriers include sterile aqueous solutions or dispersions and sterile powders for the extemporaneous preparation of sterile injectable solutions or dispersions.

In some embodiments, the pharmaceutical composition may be present in lyophilized form. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol), and suitable mixtures thereof. The invention further contemplates the inclusion of a stabilizer in the pharmaceutical composition. The proper fluidity can be maintained, for example, by the maintenance of the required particle size in the case of dispersion and by the use of surfactants.

In many cases, it may be preferable to include isotonic agents, for example, sugars, polyalcohols such as mannitol, sorbitol, or sodium chloride in the composition. By including an agent such as, monostearate salts and gelatin, the absorption of the injectable compositions can be prolonged. Moreover, the polypeptide can be formulated in a time-release formulation, for example in a composition which includes a slow release polymer. The active compounds can be prepared with carriers that may protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid and polylactic, polyglycolic copolymers (PLG). Many methods for the preparation of such formulations are known to those skilled in the art.

Modified FGF-21 polypeptides and compositions of the present disclosure may be administered by any conventional route suitable for proteins or peptides, including, but not limited to parenterally, e.g. injections including, but not limited to, subcutaneously or intravenously or any other form of injections or infusions. Polypeptide compositions can be administered by a number of routes including, but not limited to oral, intravenous, intraperitoneal, intramuscular, transdermal, subcutaneous, topical, sublingual, or rectal means. Compositions comprising modified FGF-21 may also be administered via liposomes. The modified FGF-21 polypeptide, may be used alone or in combination with other suitable components such as a pharmaceutical carrier. The modified FGF-21 polypeptide may be used in combination with other agents, including but not limited to, an oral anti-diabetic agent.

The term "anti-diabetic agent" shall mean any drug that is useful in treating, preventing, or otherwise reducing the severity of any glucose metabolism disorder, or any complications thereof, including any of the conditions, disease, or complications described herein. Anti-diabetic agents include insulin, thiazolidinediones, sulfonylureas, benzoic acid derivatives, alpha-glucosidase inhibitors, or the like.

Current drugs or anti-diabetic agents used for managing diabetes and its precursor syndromes, such as insulin resistance, that are well-known in the art include five classes of compounds: the biguanides, e.g., metformin; thiazolidinediones, e.g., troglitazone; the sulfonylureas, e.g., tolbutamide and glyburide; benzoic acid derivatives, e.g. repaglinide; and glucosidase inhibitors. In addition to these agents, a number of other therapies may be used in combination with the FGF-21 polypeptides of the present disclosure to improve glucose control, including but not limited to DPP-4 inhibitors. The lead DPP-4 compounds tested in clinical trials include Vildagliptin (Galvus) (LAF237), Sitagliptin (Januvia), Saxagliptin and Alogliptin, Novartis compound 1-[[[2-[(5-cyanopyridin-2-yl)amino]ethyl]amino]acetyl]-2-cyano-(S)-pyrrolidine (NVP DPP728)

Another category of anti-diabetic agents that is inhibitors of carnitine palmitoyl-transferase I (CPT-I), such as etomoxir.

Other known anti-diabetic agents include insulin preparations (e.g., animal insulin preparations extracted from pancreas of bovine and swine; human insulin preparations genetically synthesized using *Escherichia coli*, yeast; zinc insulin; protamine zinc insulin; fragment or derivative of insulin (e.g., INS-1), oral insulin preparation), insulin sensitizers (e.g., pioglitazone or a salt thereof (preferably hydrochloride), rosiglitazone or a salt thereof (preferably maleate), Netoglitazone, Rivoglitazone (CS-011), FK-614, the compound described in WO01/38325, Tesaglitazar (AZ-242), Ragaglitazar (N,N-622), Muraglitazar (BMS-298585), Edaglitazone (BM-13-1258), Metaglidasen (MBX-102), Naveglitazar (LY-519818), MX-6054, LY-510929, AMG-131(T-131), THR-0921), α-glucosidase inhibitors (e.g., voglibose, acarbose, miglitol, emiglitate etc.), biguanides (e.g., phenformin, metformin, buformin or a salt thereof (e.g., hydrochloride, fumarate, succinate)), insulin secretagogues [sulfonylurea (e.g., tolbutamide, glibenclamide, gliclazide, chlorpropamide, tolazamide, acetohexamide, glyclopyramide, glimepiride, glipizide, glybuzole), repaglinide, nateglinide, mitiglinide or calcium salt hydrate thereof], dipeptidyl peptidase IV inhibitors (e.g., Vidagliptin (LAF237), P32/98, Sitagliptin (MK-431), P93/01, PT-100, Saxagliptin (BMS-477118), T-6666, TS-021), P3 agonists (e.g., AJ-9677), GPR40 agonists, glucagon-like polypeptides (I) (glp I), (glp2), or other diabetogenic peptide hormones, GLP-1 receptor agonists [e.g., GLP-1, GLP-1MR agent, N,N-2211, AC-2993 (exendin-4), BIM-51077, Aib(8, 35)hGLP-1 (7,37)NH$_2$, CJC-[131], amylin agonists (e.g., pramlintide), phosphotyrosine phosphatase inhibitors (e.g., sodium vanadate), gluconeogenesis inhibitors (e.g., glycogen phosphorylase inhibitors, glucose-6-phosphatase inhibitors, glucagon antagonists), SGLT2 (sodium-glucose cotransporter) inhibitors (e.g., T-1095), 11β-hydroxysteroid dehydrogenase inhibitors (e.g., BVT-3498), adiponectin or agonists thereof, IKK inhibitors (e.g., AS-2868), leptin resistance improving drugs, somatostatin receptor agonists (compounds described in WO01/25228, WO03/42204, WO98/44921, WO98/45285, WO99/2273.5 etc.), glucokinase activators (e.g., Ro-28-1675), GIP (Glucose-dependent insulinotropic peptide) and the like can be mentioned.

The modified FGF-21 may also be made into aerosol formulations (i.e., they can be "nebulized") to be administered via inhalation. Aerosol formulations can be placed into pressurized acceptable propellants, such as dichlorodifluoromethane, propane, nitrogen, and the like.

Formulations suitable for parenteral administration, such as, for example, by intraarticular (in the joints), intravenous, intramuscular, intradermal, intraperitoneal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The formulations of modified FGF-21 can be presented in unit-dose or multi-dose sealed containers, such as ampules and vials.

The dose administered to a patient, in the context of the present disclosure, is sufficient to have a beneficial therapeutic response in the patient over time, or other appropriate activity, depending on the application. The dose is determined by the efficacy of the formulation, and the activity, stability or serum half-life of the modified FGF-21 polypeptide employed and the condition of the patient, as well as the body weight or surface area of the patient to be treated.

The dose administered, for example, to a 70 kilogram patient, is typically in the range equivalent to dosages of currently-used therapeutic proteins, adjusted for the altered activity or serum half-life of the relevant composition.

For administration, formulations of the present disclosure are administered at a rate determined by the LD-50 or ED-50 of the relevant formulation, and/or observation of any side-effects of the modified FGF-21 polypeptides at various concentrations, including but not limited to, as applied to the mass and overall health of the patient. Administration can be accomplished via single or divided doses.

Modified FGF-21 polypeptides of the present disclosure can be administered directly to a mammalian subject. Administration is by any of the routes normally used for introducing FGF-21 polypeptide to a subject. Modified FGF-21 polypeptides of the present disclosure can be prepared in a mixture in a unit dosage injectable form (including but not limited to, solution, suspension, or emulsion) with a pharmaceutically acceptable carrier. Modified FGF-21 polypeptides of the present disclosure can also be administered by continuous infusion (using, including but not limited to, minipumps such as osmotic pumps), single bolus or slow-release depot formulations.

Formulations suitable for administration include aqueous and non-aqueous solutions, isotonic sterile solutions, which can contain antioxidants, buffers, bacteriostats, and solutes that render the formulation isotonic, and aqueous and non-aqueous sterile suspensions that can include suspending agents, solubilizers, thickening agents, stabilizers, and preservatives. Solutions and suspensions can be prepared from sterile powders, granules, and tablets of the kind previously described.

The pharmaceutical compositions and formulations of the present disclosure may comprise a pharmaceutically acceptable carrier, excipient, or stabilizer.

Suitable carriers include but are not limited to, buffers containing succinate, phosphate, borate, HEPES, citrate, histidine, imidazole, acetate, bicarbonate, and other organic acids; antioxidants including but not limited to, ascorbic acid; low molecular weight polypeptides including but not limited to those less than about 10 residues; proteins, including but not limited to, serum albumin, gelatin, or immunoglobulins; hydrophilic polymers including but not limited to, polyvinylpyrrolidone; amino acids including but not limited to, glycine, glutamine, asparagine, arginine, histidine or histidine derivatives, methionine, glutamate, or lysine; monosaccharides, disaccharides, and other carbohydrates, including but not limited to, trehalose, sucrose, glucose, mannose, or dextrins; chelating agents including but not limited to, EDTA and edentate disodium; divalent metal ions including but not limited to, zinc, cobalt, or copper; sugar alcohols including but not limited to, mannitol or sorbitol; salt-forming counter ions including but not limited to, sodium and sodium chloride; and/or nonionic surfactants including but not limited to Tween™ (including but not limited to, Tween 80 (polysorbate 80) and Tween 20 (polysorbate 20), Pluronics™ and other pluronic acids, including but not limited to, and other pluronic acids, including but not limited to, pluronic acid F68 (poloxamer 188), or PEG. Suitable surfactants include for example but are not limited to polyethers based upon poly(ethylene oxide)-poly(propylene oxide)-poly(ethylene oxide), i.e., (PEO-PPO-PEO), or poly(propylene oxide)-poly(ethylene oxide)-poly(propylene oxide), i.e., (PPO-PEO-PPO), or a combination thereof. PEO-PPO-PEO and PPO-PEO-PPO are commercially available under the trade names Pluronics™, R-Pluronics™, Tetronics™ and R-Tetronics™ (BASF Wyandotte Corp., Wyandotte, Mich.) and are further described in U.S. Pat. No. 4,820,352 incorporated herein in its entirety by reference. Other ethylene/polypropylene block polymers may be suitable surfactants. A surfactant or a combination of surfactants may be used to stabilize PEGylated modified FGF-21 against one or more stresses including but not limited to stress that results from agitation. Some of the above may be referred to as "bulking agents." Some may also be referred to as "tonicity modifiers." Antimicrobial preservatives may also be applied for product stability and antimicrobial effectiveness; suitable preservatives include but are not limited to, benzyl alcohol, benzalkonium chloride, metacresol, methyl/propyl parabene, cresol, and phenol, or a combination thereof Modified FGF-21 polypeptides of the present disclosure, including those linked to water soluble polymers such as PEG can also be administered by or as part of sustained-release systems. Sustained-release compositions include, including but not limited to, semi-permeable polymer matrices in the form of shaped articles, including but not limited to, films, or microcapsules. Sustained-release matrices include from biocompatible materials such as poly(2-hydroxyethyl methacrylate), ethylene vinyl acetate (or poly-D-(−)-3-hydroxybutyric acid, polylactides (polylactic acid), polyglycolide (polymer of glycolic acid), polylactide co-glycolide (copolymers of lactic acid and glycolic acid) polyanhydrides, copolymers of L-glutamic acid and gamma-ethyl-L-glutamate, poly(ortho)esters, polypeptides, hyaluronic acid, collagen, chondroitin sulfate, carboxylic acids, fatty acids, phospholipids, polysaccharides, nucleic acids, polyamino acids, amino acids such as phenylalanine, tyrosine, isoleucine, polynucleotides, polyvinyl propylene, polyvinylpyrrolidone and silicone. Sustained-release compositions also include a liposomally entrapped compound. Liposomes containing the compound are prepared by methods known.

The dose administered to a patient in the context of the present disclosure should be sufficient to cause a beneficial response in the subject over time. Generally, the total pharmaceutically effective amount of the modified FGF-21 polypeptide of the present disclosure administered parenterally per dose is in the range of about 0.01 µg/kg/day to about 100 µg/kg, or about 0.05 mg/kg to about 1 mg/kg, of patient body weight, although this is subject to therapeutic discretion.

In some embodiments, modified FGF-21 polypeptides of the present disclosure modulate the effect of an anti-diabetic agent. In another embodiment of the present disclosure, modified FGF-21 polypeptides may be coadministered with an anti-diabetic agent. In another embodiment of the present disclosure, modified FGF-21 polypeptides may be administered before treatment with an anti-diabetic agent. In another embodiment of the present disclosure, modified FGF-21 polypeptides may be administered following treatment with an anti-diabetic agent. In another embodiment of the present disclosure, modified FGF-21 polypeptides are coadministered with metformin. In some embodiments, the modified FGF-21 polypeptides of the present disclosure are coadministered with Klotho beta. In some embodiments, the modified FGF-21 polypeptides of the present disclosure are coadministered with Klotho beta that includes one or more non-naturally encoded amino acids. In some embodiments, the modified FGF-21 polypeptides of the present disclosure are coadministered with Klotho beta and an anti-diabetic agent. In some embodiments, the modified FGF-21 polypeptides of the present disclosure are coadministered with an anti-diabetic agent. In some embodiments, modified FGF-21 polypeptides of the present disclosure are used in combination with one or more of the following: Taurine, Alpha Lipoic Acid, an extract of Mulberry, Chromium, Glutamine, Enicostemma littorale Blume, Scoparia dulcis, an extract of Tarragon and Andrographis paniculata. In some embodiments, modified FGF-21 polypeptides of the present disclosure are used in combination with one or more of the following: insulin preparations (e.g., animal insulin preparations extracted from pancreas of bovine and swine; human insulin preparations genetically synthesized using *Escherichia coli*, yeast; zinc insulin; protamine zinc insulin; fragment or derivative of insulin (e.g., INS-1), oral insulin preparation), insulin sensitizers (e.g., pioglitazone or a salt thereof (preferably hydrochloride), rosiglitazone or a salt thereof (preferably maleate), Netoglitazone, Rivoglitazone (CS-011), FK-614, the compound described in WO01/38325, Tesaglitazar (AZ-242), Ragaglitazar (N,N-622), Muraglitazar (BMS-298585), Edaglitazone (BM-13-1258), Metaglidasen (MBX-102), Naveglitazar (LY-519818), MX-6054, LY-510929, AMG-131(T-131), THR-0921), α-glucosidase inhibitors (e.g., voglibose, acarbose, miglitol, emiglitate etc.), biguanides (e.g., phenformin, metformin, buformin or a salt thereof (e.g., hydrochloride, fumarate, succinate)), insulin secretagogues [sulfonylurea (e.g., tolbutamide, glibenclamide, gliclazide, chlorpropamide, tolazamide, acetohexamide, glyclopyramide, glimepiride, glipizide, glybuzole), repaglinide, nateglinide, mitiglinide or calcium salt hydrate thereof], dipeptidyl peptidase IV inhibitors (e.g., Vidagliptin (LAF237), P32/98, Sitagliptin (MK-431), P93/01, PT-100, Saxagliptin (BMS-477118), T-6666, TS-021), β3 agonists (e.g., AJ-9677), GPR40 agonists, glucagon-like polypeptides (I) (glp I), (glp2), or other diabetogenic peptide hormones, GLP-1 receptor agonists [e.g., GLP-1, GLP-1MR agent, N,N-2211, AC-2993 (exendin-4), BIM-51077, Aib(8,35)hGLP-1 (7,37)$NH_2$, CJC-[131], amylin agonists (e.g., pramlintide), phosphotyrosine phosphatase inhibitors (e.g., sodium vanadate), gluconeogenesis inhibitors (e.g., glycogen phosphorylase inhibitors, glucose-6-phosphatase inhibitors, glucagon antagonists), SGLUT (sodium-glucose cotransporter) inhibitors (e.g., T-1095), 11β-hydroxysteroid dehydrogenase inhibitors (e.g., BVT-3498), adiponectin or agonists thereof, IKK inhibitors (e.g., AS-2868), leptin resistance improving drugs, somatostatin receptor agonists (compounds described in WO01/25228, WO03/42204, WO98/44921, WO98/45285, WO99/22735 etc.), glucokinase activators (e.g., Ro-28-1675), GIP (Glucose-dependent insulinotropic peptide).

One way in which the therapeutic efficacy of the polypeptides and combined therapies including the present disclosure's polypeptides may be determined is through a reduction in patient HbA1c levels. In one embodiment, polypeptides of the present disclosure lower HbA1c levels by at least a 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, or at least 50% change from HbA1c levels two months prior to beginning therapy with modified FGF-21 polypeptides, from three months prior to beginning therapy with modified FGF-21 polypeptides, or by percentage changes from a baseline. In another embodiment, polypeptides of the present disclosure administered to a patient also being treated with an anti-diabetic agent modulate the ability of the anti-diabetic agent to lower blood glucose.

In another embodiment, modified FGF-21 polypeptides of the present disclosure modulate the ability of Troglitazone to decrease insulin requirements. Troglitazone used in combination with a polypeptide of the present disclosure may be used to delay or prevent Type 2 diabetes in certain embodiments of the present disclosure.

In one embodiment of the present disclosure, modified FGF-21 polypeptides are coadministered with, or administered before or after treatment with, a sulfonylurea. In some embodiments of the present disclosure, treatment with a therapeutic dose of modified FGF-21 polypeptides modulates serum glucose. In another embodiment, modified FGF-21 polypeptides of the present disclosure are administered with Klotho beta which modulates the effects of the polypeptides on blood glucose. In another embodiment, modified FGF-21 polypeptides of the present disclosure are administered with Klotho beta which decreases blood glucose more than use of modified FGF-21 polypeptides alone.

XVI. Therapeutic Uses of Modified FGF-21 Polypeptides of the Present Disclosure

The modified FGF-21 polypeptides of the present disclosure may be used to treat mammals suffering from non-insulin dependent Diabetes Mellitus (NIDDM: Type 2), insulin dependent diabetes (Type 1), as well as obesity, inadequate glucose clearance, hyperglycemia, hyperinsulinemia, and any other disease or condition that may be mediated by FGF-21.

Prader-Willi syndrome (P.W.S. or PWS) is a rare genetic disorder in which seven genes (or some subset thereof) on chromosome 15 (q 11-13) are deleted or unexpressed (chromosome 15q partial deletion) on the paternal chromosome. Characteristic of PWS is low muscle tone, short stature, incomplete sexual development, cognitive disabilities, problem behaviors, and a chronic feeling of hunger that can lead to excessive eating and life-threatening obesity.

The present disclosure provides a method for treating a mammal exhibiting one or more of Type 1 diabetes, Type 2 diabetes, obesity, insulin resistance, hyperinsulinemia, glucose intolerance, or hyperglycemia, comprising administering to said mammal in need of such treatment a therapeutically effective amount of the modified FGF-21 polypeptide of the present disclosure.

The method of treating may be sufficient to achieve in said mammal at least one of the following modifications: reduction in body fat stores, decrease in insulin resistance, reduction of hyperinsulinemia, increase in glucose tolerance, and reduction of hyperglycemia.

The present disclosure also encompasses a method of reducing mortality and morbidity in critically ill patients suffering from systemic inflammatory response syndrome (SIRS) associated with infectious insults, such a sepsis, pancreatitis, ischemia, multiple trauma and tissue injury, hemorrhagic shock, immune-mediated organ injury, respiratory distress, shock, renal failure, and multiple organ dysfunction syndrome (MODS), as well as noninfectious pathologic causes which comprises administering to the critically ill patients a therapeutically effective amount of modified FGF-21.

In one embodiment, the disclosure provides compositions and methods with the modified FGF-21 polypeptides disclosed herein in combination with another agent for treating impaired glucose metabolism, such as insulin resistance, impaired insulin secretion or hyperglycemia. Such other agents include, for example, one or more of sulfonylureas, PPAR-gamma agonists, GPL-1 receptor agonists, dipeptidyl peptidase IV inhibitor, amylin analogs, biguanides, dopamine D2 receptor agonists, meglitinides, alpha-glucosidase inhibitor, antidyslipidemic bile acid sequestrant, insulin, cytokine therapy, gene therapy, and antibody therapy. In some embodiments, the modified FGF-21 polypeptide disclosed herein may be administered to a patient that does not achieve normoglycemia with administration of another treatment, e.g., treatment with metformin, pioglitazone, a sulfonylurea, a glinide, an oral thiazolidinedione (TZD) such as pioglitazone, a glucagon-like peptide 1 (GLP-1) receptor agonist such as exenatide, a DPP4 inhibitor such as sitagliptin, vildagliptin, saxagliptin, alogliptin, linagliptin, or teneligliptin, or a combination therapy such as metformin and pioglitazone, metformin and a sulfonylurea, metformin and a glinide, metformin and a TZD, metformin and pioglitazone, metformin and a GLP-1 receptor agonist, metformin and exenatide, sitagliptin and metformin, sitagliptin and simvastatin, vildagliptin and metformin, saxagliptin and metformin, alogliptin and pioglitazone, or linagliptin and metformin, or SGLT2 inhibitors such as dapagliflozin, canagliflozin, empagliflozin, ipragliflozin or tofogliflozin.

In some embodiment, the modified FGF-21 polypeptide disclosed herein may be administered for prevention or treatment of obesity (e.g., a body mass index of at least 25). Said the modified FGF-21 polypeptide may be administered in combination with an anti-obesity agent such as orlistat, rimonabant, sibutramine, a peptide YY (PYY, a 36 amino acid peptide that reduces appetite), a PYY analog, a CB-1 antagonist, rimonabant, a leptin, a leptin analog, or a phentermine In some embodiments, the modified FGF-21 polypeptide disclosed herein may be administered for prevention or treatment of Prader-Willi syndrome.

It is understood that the examples and embodiments described herein are for illustrative purposes only and that various modifications or changes in light thereof will be suggested to those of ordinary skill in the art and are to be included within the spirit and purview of this application and scope of the appended claims. It is also to be understood that the terminology used herein is for the purpose of describing exemplary embodiments only, and is not intended to limit the scope of the present disclosure, which are limited only by the appended claims. All publications, patents, patent applications, and/or other documents cited in this application are incorporated by reference in their entirety for all purposes to the same extent as if each individual publication, patent, patent application, and/or other document are individually indicated to be incorporated by reference for all purposes.

EXAMPLES

The following examples are offered to illustrate, but do not limit the claimed invention.

Example 1

Expression and Purification of FGF-21 in *E. coli*

Plasmids containing unmodified or modified FGF-21 expression constructs under control of the T7 promoter are transformed into an *E. coli* strain such as the W3110 B2 strain of *E. coli* in which expression of the T7 polymerase is under control of an arabinose-inducible promoter. Overnight bacterial cultures can be diluted 1:100 into shake flasks containing 2× YT culture media and grown at 37° C. to an $OD_{600}$ of ~0.8. Protein expression can be induced by the addition of arabinose (0.2% final), and para-acetyl-phenylalanine (pAcF) to a final concentration of 4 mM. Cultures may be incubated for a suitable duration and temperature, e.g., at 37 degrees C. for 4 hours. Cells can be pelleted and resuspended in B-PER lysis buffer (Pierce) 100 ul/OD/ml+ 10 ug/ml DNase and incubated at 37° C. for 30 min. Cellular material can be removed by centrifugation and the supernatant can be removed. The pellet can be re-suspended in an equal amount of SDS-PAGE protein loading buffer. Samples can be loaded on a 4-12% PAGE gel with MES and DTT. Methods for purification of FGF-21 are known to those of ordinary skill in the art and purification can be confirmed by SDS-PAGE, Western Blot analyses, electrospray-ionization ion trap mass spectrometry and the like.

Cell paste is resuspended by mixing to a final 10% solid in 4° C. inclusion body (IB) Buffer I (50 mM Tris pH 8.0; 100 mM NaCl; 1 mM EDTA; 1% Triton X-100; 4° C.). Cells are lysed by passing resuspended material through a micro fluidizer a total of two times, then it is centrifuged (10,000 g; 15 min; 4° C.) and the supernatant is decanted. The IB pellet is washed by resuspending in an additional volume of IB buffer I (50 mM Tris pH 8.0; 100 mM NaCl; 1 mM EDTA; 1% Triton X-100; 4° C.) and resuspended material is passed through micro fluidizer a total of two times, then it is centrifuged (10,000 g; 15 min; 4° C.) and the supernatant is decanted. The IB pellet is resuspended in one volume of buffer II (50 mM Tris pH 8.0; 100 mM NaCl; 1 mM EDTA; 4° C.), then it is centrifuged (10,000 g; 15 min; 4° C.) and the supernatant is decanted. IB pellet is then resuspended in ½ volume of buffer II (50 mM Tris pH 8.0; 100 mM NaCl; 1 mM EDTA; 4° C.). IB is aliquoted into appropriate containers, then it is centrifuged (10,000 g; 15 min; 4° C.) and the supernatant is decanted. Inclusion bodies are solubilized (this is the point at which they could otherwise be stored at −80° C. until further use.)

Inclusion bodies are solubilized to a final concentration between 10-15 mg/mL in solubilization buffer (20 mM Tris, pH 8.0; 8M Urea; 10 mM β-ME) and incubated solubilized IB at room temperature under constant mixing for 1 hour. Insoluble material is removed by filtration (0.45 μm PES filter) and the protein concentration is adjusted (not always necessary) by dilution with additional solubilization buffer (when protein concentration is high).

Refolding can be effectuated by dilution to a final protein concentration of 0.5 mg/mL in 20 mM Tris, pH 8.0; 4° C. Allowed to refold for 18 to 24 hours at 4° C.

For purification, filtered refold reaction can be passed through a 0.45 μM PES filter. Loaded material over a Q HP column (GE Healthcare) equilibrated in Buffer A (20 mM Tris, pH 7.5). Elution of unmodified or modified FGF-21 with a linear gradient over 20CV to 100% Buffer B (20 mMTris, pH 7.5; 250 mM NaCl). Monomeric FGF-21 can be thereby produced from pooled eluted fractions. Q HP pool is taken and buffer exchanged into 20 mM Tris, pH 8.0; 2M urea; 1 mM EDTA. pH is dropped to 4.0 with 50% glacial acetic acid. Sample are concentrated down to 4.0±1.0 mg/mL. To the sample is added a 12:1 molar excess PEG and a final concentration of 1% Acetic Hydrazide, pH 4.0. The sample is incubate at 28° C. for 48-72 hours. To the PEG reaction is then added a final of 50 mM Tris base, and dilute 10 fold with RO water. Conductivity is verified to be <1 mS/cm and pH is between 8.0-9.0. Material is loaded over a Source 30Q column (GE Healthcare) equilibrated in Buffer A (20 mM Tris, pH 8.0). PEG-FGF-21 is eluted with a linear gradient over 20CV to 100% B (20 mM Tris, pH 8.0; 100 mM NaCl). PEG-FGF-21 is pooled and buffer exchanged into 20 mM Tris, pH 7.4; 150 mM NaCl. PEG material is concentrated to between 1-2 mg/mL and filter sterilize using 0.22 μm PES filter. Material is stored at 4° C. For prolonged storage, flash freeze and store at −80° C.

Example 2

Methods for Production of Modified FGF-21 Polypeptides Comprising a Non-Naturally Encoded Amino Acid An introduced translation system that comprises an orthogonal tRNA (O-tRNA) and an orthogonal aminoacyl tRNA synthetase (O-RS) can be used to express modified FGF-21 containing a non-naturally encoded amino acid. The O-RS preferentially aminoacylates the O-tRNA with a non-naturally encoded amino acid. In turn the translation system inserts the non-naturally encoded amino acid into FGF-21, in response to an encoded selector codon. Suitable O-RS and O-tRNA sequences are described in WO 2006/068802 entitled "Compositions of Aminoacyl-tRNA Synthetase and Uses Thereof" (E9; SEQ ID NO: 15) and WO 2007/021297 entitled "Compositions of tRNA and Uses Thereof" (F13; SEQ ID NO: 16), which are incorporated by reference in their entirety herein. Exemplary O-RS and O-tRNA sequences are included in Table 2 below.

TABLE 2

Sequence identifiers of exemplary orthogonal tRNA (O-tRNA) and orthogonal aminoacyl tRNA synthetase (O-RS) polypeptide and polynucleotide sequences

| | | |
|---|---|---|
| SEQ ID NO: 17 | *M. jannaschii* mtRNA$_{CUA}^{Tyr}$ | tRNA |
| SEQ ID NO: 18 | HLAD03; an optimized amber suppressor tRNA | tRNA |
| SEQ ID NO: 19 | HL325A; an optimized AGGA frameshift suppressor tRNA | tRNA |
| SEQ ID NO: 20 | Aminoacyl tRNA synthetase for the incorporation of p-azido-L-phenylalanine p-Az-PheRS(6) | RS |
| SEQ ID NO: 21 | Aminoacyl tRNA synthetase for the incorporation of p-benzoyl-L-phenylalanine p-BpaRS(1) | RS |
| SEQ ID NO: 22 | Aminoacyl tRNA synthetase for the incorporation of propargyl-phenylalanine Propargyl-PheRS | RS |
| SEQ ID NO: 23 | Aminoacyl tRNA synthetase for the incorporation of propargyl-phenylalanine Propargyl-PheRS | RS |
| SEQ ID NO: 24 | Aminoacyl tRNA synthetase for the incorporation of propargyl-phenylalanine Propargyl-PheRS | RS |
| SEQ ID NO: 25 | Aminoacyl tRNA synthetase for the incorporation of p-azido-phenylalanine p-Az-PheRS(1) | RS |
| SEQ ID NO: 26 | Aminoacyl tRNA synthetase for the incorporation of p-azido-phenylalanine p-Az-PheRS(3) | RS |
| SEQ ID NO: 27 | Aminoacyl tRNA synthetase for the incorporation of p-azido-phenylalanine p-Az-PheRS(4) | RS |
| SEQ ID NO: 28 | Aminoacyl tRNA synthetase for the incorporation of p-azido-phenylalanine p-Az-PheRS(2) | RS |
| SEQ ID NO: 29 | Aminoacyl tRNA synthetase for the incorporation of p-acetyl-phenylalanine (LW1) | RS |
| SEQ ID NO:30 | Aminoacyl tRNA synthetase for the incorporation of p-acetyl-phenylalanine (LW5) | RS |
| SEQ ID NO: 31 | Aminoacyl tRNA synthetase for the incorporation of p-acetyl-phenylalanine (LW6) | RS |
| SEQ ID NO: 32 | Aminoacyl tRNA synthetase for the incorporation of p-azido-phenylalanine (AzPheRS-5) | RS |
| SEQ ID NO: 33 | Aminoacyl tRNA synthetase for the incorporation of p-azido-phenylalanine (AzPheRS-6) | RS |

TABLE 3

Exemplary FGF-21, orthogonal tRNA (O-tRNA) and an orthogonal aminoacyl tRNA synthetase (O-RS) polypeptide and polynucleotide sequences

| SEQ ID # | Sequence Name |
|---|---|
| 1 | Amino acid sequence of FGF-21 without leader (P-form)<br>HPIPDSSPLLQFGGQVRQRYLYTDDAQQTEAHLEIREDGTVGGAADQSPESLLQL<br>KALKPGVIQILGVKTSRFLCQRPDGALYGSLHFDPEACSFRELLLEDGYNVYQSE<br>AHGLPLHLPGNKSPHRDPAPRGPARFLPLPGLPPAPPEPPGILAPQPPDVGSSDPLS<br>MVGPSQGRSPSYAS |
| 2 | Amino acid sequence of FGF-21 without leader (P-form)-His tagged<br>MHHHHHHSGGHPIPDSSPLLQFGGQVRQRYLYTDDAQQTEAHLEIREDGTVGGA<br>ADQSPESLLQLKALKPGVIQILGVKTSRFLCQRPDGALYGSLHFDPEACSFRELLL<br>EDGYNVYQSEAHGLPLHLPGNKSPHRDPAPRGPARFLPLPGLPPAPPEPPGILAPQ<br>PPDVGSSDPLSMVGPSQGRSPSYAS |
| 3 | Amino acid sequence of FGF-21 with leader (P-form)-leader with 3 leucines ("209 amino acid P-form" or "P-form")<br>MDSDETGFEHSGLWVSVLAGLLLGACQAHPIPDSSPLLQFGGQVRQRYLYTDDA<br>QQTEAHLEIREDGTVGGAADQSPESLLQLKALKPGVIQILGVKTSRFLCQRPDGA<br>LYGSLHFDPEACSFRELLLEDGYNV<br>YQSEAHGLPLHLPGNKSPHRDPAPRGPARFLPLPGLPPAPPEPPGILAPQPPDVGSS<br>DPLSMVGPSQGRSPSYAS |
| 4 | Amino acid sequence of FGF-21 with leader (P-form)-leader with two leucines<br>MDSDETGFEHSGLWVSVLAGLLGACQAHPIPDSSPLLQFGGQVRQRYLYTDDAQ<br>QTEAHLEIREDGTVGGAADQSPESLLQLKALKPGVIQILGVKTSRFLCQRPDGAL<br>YGSLHFDPEACSFRELLLEDGYNVYQSEAHGLPLHLPGNKSPHRDPAPRGPARFL<br>PLPGLPPAPPEPPGILAPQPPDVGSSDPLSMVGPSQGRSPSYAS |
| 5 | Amino acid sequence of FGF-21 without leader (L-form)<br>His Pro Ile Pro Asp Ser Ser Pro Leu Leu Gln Phe Gly Gly Gln Val Arg Gln Arg Tyr Leu<br>Tyr Thr Asp Asp Ala Gln Gln Thr Glu Ala His Leu Glu Ile Arg Glu Asp Gly Thr Val<br>Gly Gly Ala Ala Asp Gln Ser Pro Glu Ser Leu Leu Gln Lou Lys Ala Leu Lys Pro Gly<br>Val Ile Gln Ile Leu Gly Val Lys Thr Ser Arg Phe Leu Cys Gln Arg Pro Asp Gly Ala Leu<br>Tyr Gly Ser Leu His Phe Asp Pro Glu Ala Cys Ser Phe Arg Glu Leu Leu Leu Glu Asp<br>Gly Tyr Asn Val Tyr Gln Ser Glu Ala His Gly Leu Pro Leu His Leu Pro Gly Asn Lys Ser<br>Pro His Arg Asp Pro Ala Pro Arg Gly Pro Ala Arg Phe Leu Pro Leu Pro Gly Leu Pro Pro<br>Ala Leu Pro Glu Pro Pro Gly Ile Leu Ala Pro Gln Pro Pro Asp Val Gly Ser Ser Asp Pro<br>Leu Ser Met Val Gly Pro Set Gln Gly Arg Ser Pro Ser Tyr Ala Ser |

TABLE 3-continued

Exemplary FGF-21, orthogonal tRNA (O-tRNA) and an orthogonal aminoacyl tRNA synthetase (O-RS) polypeptide and polynucleotide sequences

| SEQ ID # | Sequence Name |
|---|---|
| 6 | Amino acid sequence of FGF-21 with leader (L-form) - leader with 3 leucines (209 amino acid L-form)<br>Met Asp Ser Asp Glu Thr Gly Phe Glu His Ser Gly Leu Trp Val Ser Val Leu Ala Gly Leu Leu Leu Gly Ala Cys Gln Ala His Pro Ile Pro Asp Ser Ser Pro Leu Leu Gln Phe Gly Gly Gln Val Arg Gln Arg Tyr Leu Tyr Thr Asp Asp Ala Gln Gln Thr Glu Ala His Leu Glu Ile Arg Glu Asp Gly Thr Val Gly Gly Ala Ala Asp Gln Ser Pro Glu Ser Leu Leu Gln Leu Lys Ala Leu Lys Pro Gly Val Ile Gln Ile Leu Gly Val Lys Thr Ser Arg Phe Leu Cys Gln Arg Pro Asp Gly Ala Leu Tyr Gly Ser Leu His Phe Asp Pro Glu Ala Cys Ser Phe Arg Glu Leu Leu Leu Glu Asp Gly Tyr Asn Val Tyr Gln Ser Glu Ala His Gly Leu Pro Leu His Leu Pro Gly Asn Lys Ser Pro His Arg Asp Pro Ala Pro Arg Gly Pro Ala Arg Phe Leu Pro Leu Pro Gly Leu Pro Pro Ala Leu Pro Glu Pro Pro Gly Ile Leu Ala Pro Gln Pro Pro Asp Val Gly Ser Ser Asp Pro Leu Ser Met Val Gly Pro Ser Gln Gly Arg Ser Pro Ser Tyr Ala Ser |
| 7 | Amino acid sequence of FGF-21 with leader (L-form)-leader with 2 leucines (208 amino acid L-form)<br>Met Asp Ser Asp Glu Thr Gly Phe Glu His Ser Gly Leu Trp Val Ser Val Leu Ala Gly Leu Leu Gly Ala Cys Gln Ala His Pro Ile Pro Asp Ser Ser Pro Leu Leu Gln Phe Gly Gly Gln Val Arg Gln Arg Tyr Leu Tyr Thr Asp Asp Ala Gln Gln Thr Glu Ala His Leu Glu Ile Arg Glu Asp Gly Thr Val Gly Gly Ala Ala Asp Gln Ser Pro Glu Ser Leu Leu Gln Leu Lys Ala Leu Lys Pro Gly Val Ile Gln Ile Leu Gly Val Lys Thr Ser Arg Phe Leu Cys Gln Arg Pro Asp Gly Ala Leu Tyr Gly Ser Leu His Phe Asp Pro Glu Ala Cys Ser Phe Arg Glu Leu Leu Leu Glu Asp Gly Tyr Asn Val Tyr Gln Ser Glu Ala His Gly Leu Pro Leu His Leu Pro Gly Asn Lys Ser Pro His Arg Asp Pro Ala Pro Arg Gly Pro Ala Arg Phe Leu Pro Leu Pro Gly Leu Pro Pro Ala Leu Pro Glu Pro Pro Gly Ile Leu Ala Pro Gln Pro Pro Asp Val Gly Ser Ser Asp Pro Leu Ser Met Val Gly Pro Ser Gln Gly Arg Ser Pro Ser Tyr Ala Ser |
| 8 | Nucleotide Sequence for FGF-21 without leader (P-form)<br>CACCCCATCCCTGACTCCAGTCCTCTCCTGCAATTCGGGGGCCAAGTCCGGCA<br>GCGGTACCTCTACACAGATGATGCCCAGCAGACAGAAGCCCACCTGGAGATC<br>AGGGAGGATGGGACGGTGGGGGGCGCTGCTGACCAGAGCCCCGAAAGTCTC<br>CTGCAGCTGAAAGCCTTGAAGCCGGGAGTTATTCAAATCTTGGGAGTCAAGA<br>CATCCAGGTTCCTGTGCCAGCGGCCAGATGGGGCCCTGTATGGATCGCTCCA<br>CTTTGACCCTGAGGCCTGCAGCTTCCGGGAGCTGCTTCTTGAGGACGGATAC<br>AATGTTTACCAGTCCGAAGCCCACGGCCTCCCGCTGCACCTGCCAGGGAACA<br>AGTCCCCACACCGGGACCCTGCACCCCGAGGACCAGCTCGCTTCCTGCCACT<br>ACCAGGCCTGCCCCCCGCACCCCCGGAGCCACCCGGAATCCTGGCCCCCCAG<br>CCCCCCGATGTGGGCTCCTCGGACCCTCTGAGCATGGTGGGACCTTCCCAGG<br>GCCGAAGCCCCAGCTACGCTTCCTGA |
| 9 | Nucleotide Sequence for FGF-21 without leader (P-form)-His tagged<br>ATGCATCATCATCATCATCATAGCGGCGGCCACCCCATCCCTGACTCCAGTCC<br>TCTCCTGCAATTCGGGGGCCAAGTCCGGCAGCGGTACCTCTACACAGATGAT<br>GCCCAGCAGACAGAAGCCCACCTGGAGATCAGGGAGGATGGGACGGTGGGG<br>GGCGCTGCTGACCAGAGCCCCGAAAGTCTCCTGCAGCTGAAAGCCTTGAAGC<br>CGGGAGTTATTCAAATCTTGGGAGTCAAGACATCCAGGTTCCTGTGCCAGCG<br>GCCAGATGGGGCCCTGTATGGATCGCTCCACTTTGACCCTGAGGCCTGCAGC<br>TTCCGGGAGCTGCTTCTTGAGGACGGATACAATGTTTACCAGTCCGAAGCCC<br>ACGGCCTCCCGCTGCACCTGCCAGGGAACAAGTCCCCACACCGGGACCCTGC<br>ACCCCGAGGACCAGCTCGCTTCCTGCCACTACCAGGCCTGCCCCCGCACCC<br>CCGGAGCCACCCGGAATCCTGGCCCCCCAGCCCCCCGATGTGGGCTCCTCGG<br>ACCCTCTGAGCATGGTGGGACCTTCCCAGGGCCGAAGCCCCAGCTACGCTTC<br>CTGA |
| 10 | Nucleotide Sequence for FGF-21 with leader (P-form)-leader with 3 leucines<br>ATGGACTCGGACGAGACCGGGTTCGAGCACTCAGGACTGTGGGTTTCTGTGC<br>TGGCTGGTCTTCTGCTGGGAGCCTGCAGGCACACCCCATCCCTGACTCCAGT<br>CCTCTCCTGCAATTCGGGGGCCAAGTCCGGCAGCGGTACCTCTACACAGATG<br>ATGCCCAGCAGACAGAAGCCCACCTGGAGATCAGGGAGGATGGGACGGTGG<br>GGGGCGCTGCTGACCAGAGCCCCGAAAGTCTCCTGCAGCTGAAAGCCTTGAA<br>GCCGGGAGTTATTCAAATCTTGGGAGTCAAGACATCCAGGTTCCTGTGCCAG<br>CGGCCAGATGGGGCCCTGTATGGATCGCTCCACTTTGACCCTGAGGCCTGCA<br>GCTTCCGGGAGCTGCTTCTTGAGGACGGATACAATGTTTACCAGTCCGAAGC<br>CCACGGCCTCCCGCTGCACCTGCCAGGGAACAAGTCCCCACACCGGGACCCT<br>GCACCCCGAGGACCAGCTCGCTTCCTGCCACTACCAGGCCTGCCCCCGCAC<br>CCCCGGAGCCACCCGGAATCCTGGCCCCCCAGCCCCCCGATGTGGGCTCCTC<br>GGACCCTCTGAGCATGGTGGGACCTTCCCAGGGCCGAAGCCCCAGCTACGCT<br>TCCTGA |

TABLE 3-continued

Exemplary FGF-21, orthogonal tRNA (O-tRNA) and an orthogonal aminoacyl
tRNA synthetase (O-RS) polypeptide and polynucleotide sequences

| SEQ ID # | Sequence Name |
|---|---|
| 11 | Nucleotide Sequence for FGF-21 with leader (P-form)-leader with 2 leucines<br>ATGGACTCGGACGAGACCGGGTTCGAGCACTCAGGACTGTGGGTTTCTGTGC<br>TGGCTGGTCTTCTGGGAGCCTGCCAGGCACACCCCATCCCTGACTCCAGTCCT<br>CTCCTGCAATTCGGGGGCCAAGTCCGGCAGCGGTACCTCTACACAGATGATG<br>CCCAGCAGACAGAAGCCCACCTGGAGATCAGGGAGGATGGGACGGTGGGGG<br>GCGCTGCTGACCAGAGCCCCGAAAGTCTCCTGCAGCTGAAAGCCTTGAAGCC<br>GGGAGTTATTCAAATCTTGGGAGTCAAGACATCCAGGTTCCTGTGCCAGCGG<br>CCAGATGGGGCCCTGTATGGATCGCTCCACTTTGACCCTGAGGCCTGCAGCTT<br>CCGGGAGCTGCTTCTTGAGGACGGATACAATGTTTACCAGTCCGAAGCCCAC<br>GGCCTCCCGCTGCACCTGCCAGGGAACAAGTCCCCACACCGGGACCCTGCAC<br>CCCGAGGACCAGCTCGCTTCCTGCCACTACCAGGCCTGCCCCCCGCACCCCC<br>GGAGCCACCCGGAATCCTGGCCCCCAGCCCCCCGATGTGGGCTCCTCGGAC<br>CCTCTGAGCATGGTGGGACCTTCCCAGGGCCGAAGCCCCAGCTACGCTTCCT<br>GA |
| 12 | Nucleotide Sequence for FGF-21 without leader (L-form)<br>CACCCCATCCCTGACTCCAGTCCTCTCCTGCAATTCGGGGCCAAGTCCGGCAG<br>CGGTACCTCTACACAGATGATGCCCAGCAGACAGAAGCCCACCTGGAGATCA<br>GGGAGGATGGGACGGTGGGGGGCGCTGCTGACCAGAGCCCCGAAAGTCTCC<br>TGCAGCTGAAAGCCTTGAAGCCGGGAGTTATTCAAATCTTGGGAGTCAAGAC<br>ATCCAGGTTCCTGTGCCAGCGGCCAGATGGGGCCCTGTATGGATCGCTCCAC<br>TTTGACCCTGAGGCCTGCAGCTTCCGGGAGCTGCTTCTTGAGGACGGATACA<br>ATGTTTACCAGTCCGAAGCCCACGGCCTCCCGCTGCACCTGCCAGGGAACAA<br>GTCCCCACACCGGGACCCTGCACCCCGAGGACCAGCTCGCTTCCTGCCACTA<br>CCAGGCCTGCCCCCCGCACTCCCGGAGCCACCCGGAATCCTGGCCCCCCAGC<br>CCCCCGATGTGGGCTCCTCGGACCCTCTGAGCATGGTGGGACCTTCCCAGGG<br>CCGAAGCCCAGCTACGCTTCCTGA |
| 13 | Nucleotide Sequence for FGF-21 with leader (L-form) - leader with 3 leucines<br>ATG GAC TCG GAC GAG ACC GGG TTC GAG CAC TCA GGA CTG TGG GTT<br>TCT GTG CTG GCT GGT CTT CTG CTG GGA GCC TGC CAG GCA CAC CCC<br>ATC CCT GAC TCC AGT CCT CTC CTG CAA TTC GGG GGC CAA GTC CGG<br>CAG CGG TAC CTC TAC ACA GAT GAT GCC CAG CAG ACA GAA GCC CAC<br>CTG GAG ATC AGG GAG GAT GGG ACG GTG GGG GGC GCT GCT GAC CAG<br>AGC CCC GAA AGT CTC CTG CAG CTG AAA GCC TTG AAG CCG GGA GTT<br>ATT CAA ATC TTG GGA GTC AAG ACA TCC AGG TTC CTG TGC CAG CGG<br>CCA GAT GGG GCC CTG TAT GGA TCG CTC CAC TTT GAC CCT GAG GCC<br>TGC AGC TTC CGG GAG CTG CTT CTT GAG GAC GGA TAC AAT GTT TAC<br>CAG TCC GAA GCC CAC GGC CTC CCG CTG CAC CTG CCA GGG AAC AAG<br>TCC CCA CAC CGG GAC CCT GCA CCC CGA GGA CCA GCT CGC TTC CTG<br>CCA CTA CCA GGC CTG CCC CCC GCA CTC CCG GAG CCA CCC GGA ATC<br>CTG GCC CCC CAG CCC CCC GAT GTG GGC TCC TCG GAC CCT CTG AGC<br>ATG GTG GGA CCT TCC CAG GGC CGA AGC CCC AGC TAC GCT TCC TGA |
| 14 | Nucleotide Sequence for FGF-21 with leader (L-form) - leader with 2 leucines<br>ATG GAC TCG GAC GAG ACC GGG TTC GAG CAC TCA GGA CTG TGG GTT<br>TCT GTG CTG GCT GGT CTT CTG GGA GCC TGC CAG GCA CAC CCC ATC<br>CCT GAC TCC AGT CCT CTC CTG CAA TTC GGG GGC CAA GTC CGG CAG<br>CGG TAC CTC TAC ACA GAT GAT GCC CAG CAG ACA GAA GCC CAC CTG<br>GAG ATC AGG GAG GAT GGG ACG GTG GGG GGC GCT GCT GAC CAG AGC<br>CCC GAA AGT CTC CTG CAG CTG AAA GCC TTG AAG CCG GGA GTT ATT<br>CAA ATC TTG GGA GTC AAG ACA TCC AGG TTC CTG TGC CAG CGG CCA<br>GAT GGG GCC CTG TAT GGA TCG CTC CAC TTT GAC CCT GAG GCC TGC<br>AGC TTC CGG GAG CTG CTT CTT GAG GAC GGA TAC AAT GTT TAC CAG<br>TCC GAA GCC CAC GGC CTC CCG CTG CAC CTG CCA GGG AAC AAG TCC<br>CCA CAC CGG GAC CCT GCA CCC CGA GGA CCA GCT CGC TTC CTG CCA<br>CTA CCA GGC CTG CCC CCC GCA CTC CCG GAG CCA CCC GGA ATC CTG<br>GCC CCC CAG CCC CCC GAT GTG GGC TCC TCG GAC CCT CTG AGC ATG<br>GTG GGA CCT TCC CAG GGC CGA AGC CCC AGC TAC GCT TCC TGA |
| 34 | Amino acid sequence of FGF-21 (Rattus norvegicus - ref\|NP_570108.1\|[18543365])<br>Met Asp Trp Met Lys Ser Arg Val Gly Ala Pro Gly Leu Trp Val Cys Leu Leu Leu Pro<br>Val Phe Leu Leu Gly Val Cys Glu Ala Tyr Pro Ile Ser Asp Ser Ser Pro Leu Leu Gln Phe<br>Gly Gly Gln Val Arg Gln Arg Tyr Leu Tyr Thr Asp Asp Gln Asp Thr Glu Ala His<br>Leu Glu Ile Arg Glu Asp Gly Thr Val Val Gly Thr Ala His Arg Ser Pro Glu Ser Leu Leu<br>Glu Leu Lys Ala Leu Lys Pro Gly Val Ile Gln Ile Leu Gly Val Lys Ala Ser Arg Phe Leu<br>Cys Gln Gln Pro Asp Gly Thr Leu Tyr Gly Ser Pro His Phe Asp Pro Glu Ala Cys Ser Phe<br>Arg Glu Leu Leu Leu Lys Asp Gly Tyr Asn Val Tyr Gln Ser Glu Ala His Gly Leu Pro<br>Leu Arg Leu Pro Gln Lys Asp Ser Gln Asp Pro Ala Thr Arg Gly Pro Val Arg Phe Leu<br>Pro Met Pro Gly Leu Pro His Glu Pro Gln Glu Gln Pro Gly Val Leu Pro Pro Glu Pro Pro<br>Asp Val Gly Ser Ser Asp Pro Leu Ser Met Val Glu Pro Leu Gln Gly Arg Ser Pro Ser Tyr<br>Ala Ser |

TABLE 3-continued

Exemplary FGF-21, orthogonal tRNA (O-tRNA) and an orthogonal aminoacyl
tRNA synthetase (O-RS) polypeptide and polynucleotide sequences

| SEQ ID # | Sequence Name |
|---|---|
| 35 | Amino acid sequence of FGF-21 (*Mus musculus* - ref\|NP_064397.1\|[9910218])<br>Met Glu Trp Met Arg Ser Arg Val Gly Thr Leu Gly Leu Trp Val Arg Leu Leu Leu Ala<br>Val Phe Leu Leu Gly Val Tyr Gln Ala Tyr Pro Ile Pro Asp Ser Ser Pro Leu Leu Gln Phe<br>Gly Gly Gln Val Arg Gln Arg Tyr Leu Tyr Thr Asp Asp Gln Asp Thr Glu Ala His<br>Leu Glu Ile Arg Glu Asp Gly Thr Val Val Gly Ala Ala His Arg Ser Pro Glu Ser Leu Leu<br>Glu Leu Lys Ala Leu Lys Pro Gly Val Ile Gln Ile Leu Gly Val Lys Ala Ser Arg Phe Leu<br>Cys Gln Gln Pro Asp Gly Ala Leu Tyr Gly Ser Pro His Phe Asp Pro Glu Ala Cys Ser Phe<br>Arg Glu Leu Leu Leu Glu Asp Gly Tyr Asn Val Tyr Gln Ser Glu Ala His Gly Leu Pro<br>Leu Arg Leu Pro Gln Lys Asp Ser Pro Asn Gln Asp Ala Thr Ser Trp Gly Pro Val Arg<br>Phe Leu Pro Met Pro Gly Leu Leu His Glu Pro Gln Asp Gln Ala Gly Phe Leu Pro Pro<br>Glu Pro Pro Asp Val Gly Ser Ser Asp Pro Leu Ser Met Val Glu Pro Leu Gln Gly Arg Ser<br>Pro Ser Tyr Ala Ser |
| 36 | Amino acid sequence of FGF-21 (*Danio rerio* -ref\|NP_001038789.1\|[113671792])<br>Met Leu Phe Ala Cys Phe Phe Ile Phe Phe Ala Leu Phe Pro His Leu Arg Trp Cys Met<br>Tyr Val Pro Ala Gln Asn Val Leu Leu Gln Phe Gly Thr Gln Val Arg Glu Arg Leu Leu<br>Tyr Thr Asp Gly Leu Phe Leu Glu Met Asn Pro Asp Gly Ser Val Lys Gly Val Ser Pro Glu<br>Lys Asn Leu Asn Cys Val Leu Glu Leu Arg Ser Val Lys Ala Gly Glu Thr Val Ile Gln Ser<br>Ala Ala Thr Ser Leu Tyr Leu Cys Val Asp Asp Gln Asp Lys Leu Lys Gly Gln His His<br>Tyr Ser Ala Leu Asp Cys Thr Phe Gln Glu Leu Leu Leu Asp Gly Tyr Ser Phe Phe Leu<br>Ser Pro His Thr Asn Leu Pro Val Ser Leu Leu Ser Arg Gln Lys Lys His Gly Leu Asn Pro Leu<br>Ser Arg Phe Leu Pro Val Ser Arg Ala Glu Asp Ser Arg Thr Gln Glu Val Lys Gln Tyr Ile<br>Gln Asp Ile Asn Leu Asp Ser Asp Asp Pro Leu Gly Met Gly His Arg Ser His Leu Gln<br>Thr Val Phe Ser Pro Ser Leu His Thr Lys Lys |
| 37 | Amino acid sequence of Klotho beta (*Homo sapiens* - ref\|NP_783864.1\|[28376633])<br>MKPGCAAGSPGNEWIFFSTDEITTRYRNTMSNGGLQRSVILSALILLRAVTGFSG<br>DGRAIWSKNPNFTPVNESQLFLYDTFPKNFFWGIGTGALQVEGSWKKDGKGPSI<br>WDHFIHTHLKNVSSTNGSSDSYIFLEKDLSALDFIGVSFYQFSISWPRLFPDGIVTV<br>ANAKGLQYYSTLLDALVLRNIEIVTLYHWDLPLALQEKYGGWKNDTIIDIFNDY<br>ATYCFQMFGDRVKYWITIHNPYLVAWHGYGTGMHAPGEKGNLAAVYTVGHNL<br>IKAHSKVWHNYNTHFRPHQKGWLSITLGSHWIEPNRSENTMDIFKCQQSMVSVL<br>GWFANPIHGDGDYPEGMRKKLFSVLPIFSEAEKHEMRGTADFFAFSFGPNNFKPL<br>NTMAKMGQNVSLNLREALNWIKLEYNNPRILIAENGWFTDSRVKTEDTTAIYM<br>MKNFLSQVLQAIRLDEIRVFGYTAWSLLDGFEWQDAYTIRRGLFYVDFNSKQKE<br>RKPKSSAHYYKQIIRENGFSLKESTPDVQGQFPCDFSWGVTESVLKPESVASSPQF<br>SDPHLYVWNATGNRLLHRVEGVRLKTRPAQCTDFVNIKKQLEMLARMKVTHY<br>RFALDWASVLPTGNLSAVNRQALRYYRCVVSEGLKLGISAMVTLYYPTHAHLG<br>LPEPLLHADGWLNPSTAEAFQAYAGLCFQELGDLVKLWITINEPNRLSDIYNRSG<br>NDTYGAAHNLLVAHALAWRLYDRQFRPSQRGAVSLSLHADWAEPANPYADSH<br>WRAAERFLQFEIAWFAEPLFKTGDYPAAMREYIASKHRRGLSSSALPRLTEAERR<br>LLKGTVDFCALNHFTTRFVMHEQLAGSRYDSRDIQFLQDITRLSSPTRLAVIPW<br>GVRKLLRWVRRNYGDMDIYITASGIDDQALEDDRLRKYYLGKYLQEVLKAYLI<br>DKVRIKGYYAFKLAEEKSKPRFGFFTSDFKAKSSIQFYNKVISSRGFPFENSSSRCS<br>QTQENTECTVCLFLVQKKPLIFLGCCFFSTLVLLLSIAIFQRQKRRKFWKAKNLQH<br>IPLKKGKRVVS |
| 38 | Amino acid sequence of Klotho beta (*Mus musculus* - refNP_112457.1 GI: 13626032)<br>MKTGCAAGSPGNEWIFFSSDERNTRSRKTMSNRALQRSAVLSAFVLLRAVTGFS<br>GDGKAIWDKKQYVSPVNPSQLFLYDTFPKNFSWGVGTGAFQVEGSWKTDGRGP<br>SIWDRYVYSHLRGVNGTDRSTDSYIFLEKDLLALDFLGVSFYQFSISWPRLFPNGT<br>VAAVNAQGLRYYRALLDSLVLRNIEPIVTLYHWDLPLTLQEEYGGWKNATMID<br>LFNDYATYCFQTFGDRVKYWITIHNPYLVAWHGFGTGMHAPGEKGNLTAVYTV<br>GHNLIKAHSKVWHNYDKNFRPHQKGWLSITLGSHWIEPNRTDNMEDVINCQHS<br>MSSVLGWFANPIHGDGDYPEFMKTGAMIPEFSEAEKEEVRGTADFFAFSFGPNNF<br>RPSNTVVKMGQNVSLNLRQVLNWIKLEYDDPQILISENGWFTDSYIKTEDTTAIY<br>MMKNFLNQVLQAIKFDEIRVFGYTAWTLLDGFEWQDAYTTRRGLFYVDFNSEQ<br>KERKPKSSAHYYKQIIQDNGFPLKESTPDMKGRFPCDFSWGVTESVLKPEFTVSS<br>PQFTDPHLYVWNVTGNRLLYRVEGVRLKTRPSQCTDYVSIKKRVEMLAKMKVT<br>HYQFALDWTSILPTGNLSKVNRQVLRYYRCVVSEGLKLGVFPMVTLYHPTHSHL<br>GLPLPLLSSGGWLNMNTAKAFQDYAELCFRELGDLVKLWITINEPNRLSDMYNR<br>TSNDTYRAAHNLMIAHAQVWHLYDRQYRPVQHGAVSLSLHCDWAEPANPFVD<br>SHWKAAERFLQFEIAWFADPLFKTGDYPSVMKEYIASKNQRGLSSSVLPRFTAKE<br>SRLVKGTVDFYALNHFTTRFVIHKQLNTNRSVADRDVQFLQDITRLSSPSRLAVT<br>PWGVRKLLAWIRRNYRDRDIYITANGIDDLALEDDQIRKYYLEKYVQEALKAYL<br>IDKVKIKGYYAFKLTEEKSKPRFGFFTSDFRAKSSVQFYSKLISSSGLPAENRSPAC<br>GQPAEDTDCTICSFLVEKKPLIFFGCCFISTLAVLLSITVFHHQKRRKFQKARNLQ<br>NIPLKKGHSRVFS |
| 39 | OmpA nucleotide leader sequence<br>atgaaaaaaactgctatcgcgatcgctgtagctctggctggtttcgcgaccgtagctaacgct |
| 40 | OmpA amino acid leader sequence<br>M K K T A I A I A V A L A G F A T V A N A |

TABLE 3-continued

Exemplary FGF-21, orthogonal tRNA (O-tRNA) and an orthogonal aminoacyl tRNA synthetase (O-RS) polypeptide and polynucleotide sequences

| SEQ ID # | Sequence Name |
|---|---|
| 41 | MalE nucleotide leader sequence<br>atgaaaataaaaacaggtgcacgcatcctcgcattatccgcattaacgacgatgatgttttccgcctceggctctcgcc |
| 42 | MalE amino acid leader sequence<br>M K I K T G A R I L A L S A L T T M M F S A S A L A |
| 43 | StII nucleotide leader sequence<br>atgaaaaagaatatcgcatttettettgcatctatgttcgttttttctattgctacaaatgcctatgca |
| 44 | StII amino acid leader sequence<br>M K K N I A F L L A S M F V F S I A T N A Y A |

The transformation of E. coli with plasmids containing the modified FGF-21 gene and the orthogonal aminoacyl tRNA synthetase/tRNA pair (specific for the desired non-naturally encoded amino acid) allows the site-specific incorporation of non-naturally encoded amino acid into the modified FGF-21 polypeptide.

Wild type mature FGF-21 can be amplified by PCR from a cDNA synthesis reaction, e.g., derived from healthy human liver polyA+mRNA (Biochain) using standard protocols and cloned into a vector such as pET30 (e.g., utilizing the NcoI-BamHI cleavage sites). Following optionally sequence confirmation, FGF-21 (which may include a purification tag such as an N-terminal HHHHHHSGG (SEQ ID NO:490)sequence) can be subcloned. For example, FGF-21 can be subcloned into a suppression vector containing an amber suppressor tyrosyl tRNA$^{Tyr/CUA}$ from Methanococcus jannaschii (Mj tRNA$^{Typ/CUA}$) and linked to a suitable promoter, e.g., under constitutive control of a synthetic promoter derived from the E. coli lipoprotein promoter sequence (Miller, J. H., Gene, 1986), as well as well as the orthogonal tyrosyl-tRNA-synthetase (MjTyrRS) under control of the E. coli GlnRS promoter. Expression of unmodified or modified FGF-21 can be under control of the T7 promoter. Amber mutations can be introduced using standard quick change mutation protocols (Stratagene; La Jolla, Calif.). Constructs may be sequence verified.

Two distinct non-naturally encoded amino acids may be introduced into modified FGF-21 polypeptides, by introducing a selector codon at two distinct sites within the nucleic acid Suppression with Para-Acetyl-Phenylalanine (pAcF)

Plasmids containing modified FGF-21 expression constructs and O-tRNA and O-RS expression constructs (which may be in the same or different plasmids or stably transfected into the strain) can be transformed into the W3110 B2 strain of E. coli in which expression of the T7 polymerase is under control of an arabinose-inducible promoter. Overnight bacterial cultures can be diluted 1:100 into shake flasks containing 2×YT culture media and grown at 37° C. to an OD$_{600}$ of ~0.8. Protein expression can be induced by the addition of arabinose (0.2% final), and para-acetyl-phenylalanine (pAcF) to a final concentration of 4 mM. Cultures may be incubated for a suitable duration and temperature, e.g., at 37 degrees C. for 4 hours. Cells can be pelleted and resuspended in B-PER lysis buffer (Pierce) 100 ul/OD/ml+ 10 ug/ml DNase and incubated at 37° C. for 30 min. Cellular material can be removed by centrifugation and the supernatant can be removed. The pellet can be re-suspended in an equal amount of SDS-PAGE protein loading buffer. Samples can be loaded on a 4-12% PAGE gel with MES and DTT.

Methods for purification of FGF-21 are known to those of ordinary skill in the art and purification can be confirmed by SDS-PAGE, Western Blot analyses, electrospray-ionization ion trap mass spectrometry and the like.

His-tagged or non-His-tagged mutant FGF-21 proteins can be purified using methods known to those of ordinary skill in the art. For example, the ProBond Nickel-Chelating Resin (Invitrogen, Carlsbad, Calif.) may be used via the standard His-tagged protein purification procedures provided by the manufacturer.

Example 3

Introduction of a Carbonyl-Containing Amino Acid into a Modified FGF-21 Polypeptide and Subsequent Reaction with an Aminooxy-Containing PEG The following exemplary method may be used for the generation of a modified FGF-21 polypeptide linked to a half-life extending moiety. The method incorporates a ketone-containing non-naturally encoded amino acid that is subsequently reacted with a half-life extending moiety such as an aminooxy-containing PEG having a molecular weight of approximately 30,000 Da. A selected residue of FGF-21 is substituted with a non-naturally encoded amino acid having the following structure:

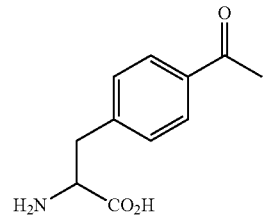

The sequences utilized for site-specific incorporation of p-acetyl-phenylalanine into FGF-21 may be SEQ ID NO: 1 (FGF-21), SEQ ID NO: 16 or 17 (muttRNA, M. jannaschii mtRNA$_{CUA}^{Tyr}$), 15, 29, 30 or 31 (TyrRS LW1, 5, or 6), or any modified FGF-21 polypeptide described herein.

Once modified, the FGF-21 polypeptide comprising the carbonyl-containing amino acid is reacted with an aminooxy-containing PEG derivative of the form:

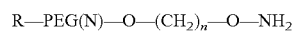

where R is methyl, n is 3 and N is a selected molecular weight, e.g., approximately 30,000 Da.

Alternatively, the ketone-containing non-naturally encoded amino acid can be liked to a PEG reagent having the following structure:

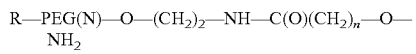

R—PEG(N)—O—(CH$_2$)$_2$—NH—C(O)(CH$_2$)$_n$—O—NH$_2$ where R=methyl, n=4 and N is a selected molecular weight, e.g., approximately 30,000 Da.

The purified modified FGF-21 containing p-acetylphenyl-alanine dissolved at 10 mg/mL in 25 mM MES (Sigma Chemical, St. Louis, Mo.) pH 6.0, 25 mM Hepes (Sigma Chemical, St. Louis, Mo.) pH 7.0, or in 10 mM Sodium Acetate (Sigma Chemical, St. Louis, Mo.) pH 4.5, is reacted with a 10 to 100-fold excess of aminooxy-containing PEG, and then stirred for 10-16 hours at room temperature (Jencks, W. *J. Am. Chem. Soc.* 1959, 81, pp 475). The PEG-FGF-21 is then diluted into appropriate buffer for immediate purification and analysis.

Example 4

Production of Modified FGF-21 Polypeptides

Polynucleotides encoding each of the modified FGF-21 polypeptides shown in FIG. 1A-B were produced. DNA codon usage in the polynucleotide sequences was optimized for *E. coli* expression using standard methods known in the art (SEQ ID NOs: 317 and 318 are exemplary polynucleotide sequences that encode Compound 2 and Pegylated Compound 2, respectively). If a connector peptide was present, its coding sequence was selected based upon the standard genetic code, e.g., GGU, GGC, GGA, or GGG for glycine, UCU, UCC, UCA, UCG, AGU, or AGC for serine, CAU or CAC for histidine, etc. The modified FGF-21 polypeptides were expressed in *E. coli* and purified (exemplary methods are described herein). Modified FGF-21 polypeptides containing the non-naturally encoded amino acid para-acetyl-phenylalanine (abbreviated pACF or pAF) were produced (exemplary methods are provided in Example 2). In brief, the encoding polynucleotide was further modified to incorporate a selector codon at the corresponding position in the polynucleotide sequence in order to encode the pACF, and were expressed in a cell engineered to express an orthogonal tRNA (O-tRNA) and an orthogonal aminoacyl tRNA synthetase (O-RS), such that the selector codon directed inclusion of the pACF at the selected position. The pACF was then linked to a poly (ethylene glycol) (PEG) having an average molecular weight of about 30 kDa (exemplary methods are provided in Example 3).

```
Compound 2 Coding Sequence
                                                                  (SEQ ID NO: 317)
        M   H   P   I   P   D   S   S   P   L   L   Q   F   G   G   Q   V   R   Q   R
    1 ATG CAT CCT ATT CCT GAT TCT TCT CCT CTG CTG CAA TTT GGG GGT CAG GTG CGC CAA CGT Y   L   Y   T   D   D   A   Q   Q   T   E   A   H   L   E   I   R   E   D   G
   61 TAC CTG TAC ACC GAC GAT GCG CAA CAG ACT GAG GCT CAC CTG GAG ATC CGT GAG GAC GGG T   V   G   G   A   D   Q   S   P   E   S   L   L   Q   L   K   A   L   K
  121 ACT GTC GGA GGG GCT GCC GAT CAA TCC CCA GAG TCA CTG CTG CAA CTG AAA GCC CTG AAG P   G   V   I   Q   I   L   G   V   K   T   S   R   F   L   C   Q   R   P   D
  181 CCT GGG GTC ATT CAG ATC CTG GGC GTA AAG ACG AGT CGT TTC CTG TGC CAA CGT CCT GAC G   A   L   Y   G   S   L   H   F   D   P   E   A   C   S   F   R   E   L   L
  241 GGG GCA CTG TAT GGC TCG CTG CAT TTT GAT CCT GAG GCT TGT AGT TTT CGC GAA CTG CTG L   E   D   G   Y   N   V   Y   Q   S   E   A   H   G   L   P   L   H   L   G
  301 CTG GAA GAT GGT TAC AAT GTG TAT CAG AGT GAA GCA CAC GGT CTG CCT CTG CAC CTG GGT S   G   R   G   P   A   R   F   L   P   L   P   G   L   P   P   A   P   P   E
  361 TCT GGT CGT GGT CCG GCG CGT TTT CTG CCA CTG CCT GGC CTG CCT CCA GCA CCA CCT GAA P   P   G   I   L   A   P   Q   P   P   D   V   G   S   S   D   P   L   S   M
  421 CCA CCG GGT ATT CTG GCT CCG CAA CCT CCA GAC GTC GGG AGT TCA GAT CCT CTG TCG ATG V   E   P   S   Q   G   R   S   P   S   Y   A   S
  481 GTA GAA CCG TCA CAA GGT CGC TCTCCT AGT TAC GCG TCA PEGylated-Compound 2 Coding Sequence
                                                                  (SEQ ID NO: 318)
        M   H   P   I   P   D   S   S   P   L   L   Q   F   G   G   Q   V   R   Q   R
    1 ATG CAT CCT ATT CCT GAT TCT TCT CCT CTG CTG CAA TTT GGG GGT CAG GTG CGC CAA CGT Y   L   Y   T   D   D   A   Q   Q   T   E   A   H   L   E   I   R   E   D   G
   61 TAC CTG TAC ACC GAC GAT GCG CAA CAG ACT GAG GCT CAC CTG GAG ATC CGT GAG GAC GGG T   V   G   G   A   D   Q   S   P   E   S   L   L   Q   L   K   A   L   K
  121 ACT GTC GGA GGG GCT GCC GAT CAA TCC CCA GAG TCA CTG CTG CAA CTG AAA GCC CTG AAG P   G   V   I   Q   I   L   G   V   K   T   S   R   F   L   C   Q   R   P   D
  181 CCT GGG GTC ATT CAG ATC CTG GGC GTA AAG ACG AGT CGT TTC CTG TGC CAA CGT CCT GAC G   A   L   Y   G   S   L   H   F   D   P   E   A   C   S   F   R   E   L   L
  241 GGG GCA CTG TAT GGC TCG CTG CAT TTT GAT CCT GAG GCT TGT AGT TTT CGC GAA CTG CTG L   E   D   G   Y   N   V   Y   pAF S   E   A   H   G   L   P   L   H   L   G
  301 CTG GAA GAT GGT TAC AAT GTG TAT TAG AGT GAA GCA CAC GGT CTG CCT CTG CAT CTG GGC
```

```
        S   G   R   G   P   A   R   F   L   P   L   P   G   L   P   P   A   P   P   E
361    TCC GGC CGC GGT CCG GCC CGT TTT CTG CCA CTG CCT GGC CTG CCT CCA GCA CCA CCT GAA

P   P   G   I   L   A   P   Q   P   P   D   V   G   S   S   D   P   L   S   M
421    CCA CCG GGT ATT CTG GCT CCG CAA CCT CCA GAC GTC GGG AGT TCA GAT CCT CTG TCG ATG

V   E   P   S   Q   G   R   S   P   S   Y   A   S
481    GTA GAA CCG TCA CAA GGT CGC TCT CCT AGT TAC GCG TCA
```

As detailed in the examples that follow, the modified FGF-21 polypeptides were further characterized, including testing for in vitro biological activity, stability, propensity for deamidation and aggregate formation, resistance to proteolysis in vivo, immunogenicity, pharmacokinetics, and biological activity in vivo in a diabetes model.

The full polypeptide sequence of the modified FGF-21 polypeptides produced (whose partial sequences are shown in FIG. 1A-B) are as follows:

Compound 1
(SEQ ID NO: 101)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLPGNKSPHRDPAPRGPARFLPLPGLP
PAPPEPPGILAPQPPDVGSSDPLSMVGPSQGRSPSYAS Compound 2
(SEQ ID NO: 102)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLGSGRGPARFLPLPGLPPAPPEPPGI
LAPQPPDVGSSDPLSMVEPSQGRSPSYAS Compound 3
(SEQ ID NO: 103)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLPGNKSPHRDPAPRGPARFLPLPGLP
PAPPEPPGILAPQPPDVGSSDPLSMVEPSQGRSPSYAS Compound 4
(SEQ ID NO: 104)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLPGKKSPHRDPAPRGPARFLPLPGLP
PAPPEPPGILAPQPPDVGSSDPLSMVEPSQGRSPSYAS Compound 5
(SEQ ID NO: 105)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLPGDKSRDPAPRGPARFLPLPGLPPA
PPEPPGILAPQPPDVGSSDPLSMVEPSQGRSPSYAS Compound 6
(SEQ ID NO: 106)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLPGHKSRDPAPRGPARFLPLPGLPPA
PPEPPGILAPQPPDVGSSDPLSMVEPSQGRSPSYAS Compound 7
(SEQ ID NO: 107)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLPGDKSPHRDPAPRGPARFLPLPGLP
PAPPEPPGILAPQPPDVGSSDPLSMVEPSQGRSPSYAS Compound 8
(SEQ ID NO: 108)
MHPIPDSSPLLQFGGQVRQRYLYTDDAQQTEAHLEIREDGTVGGAADQSPESLLQLKALKPGVIQILGVKTS
RFLCQRPDGALYGSLHFDPEACSFRELLLEDGYNVYQSEAHGLPLHLGSGARFLPLPGLPPAPPEPPGILAP
QPPDVGSSDPLSMVEPSQGRSPSYAS -continued Compound 9
(SEQ ID NO: 109)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGQKSPHRDPAPRGPARFLPLPGLP

PAPPEPPGILAPQPPDVGSSDPLSMVEPSQGRSPSYAS

Compound 10
(SEQ ID NO: 110)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGSGGPARFLPLPGLPPAPPEPPGIL

APQPPDVGSSDPLSMVEPSQGRSPSYAS

Compound 11
(SEQ ID NO: 111)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGSGHRDPAPRGPARFLPLPGLPPAP

PEPPGILAPQPPDVGSSDPLSMVEPSQGRSPSYAS

Compound 12
(SEQ ID NO: 112)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPHHSGRDPAPRGPARFLPLPGLPPA

PPEPPGILAPQPPDVGSSDPLSMVEPSQGRSPSYAS

Compound 13
(SEQ ID NO: 113)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGKDSQDPAPRGPARFLPLPGLPPA

PPEPPGILAPQPPDVGSSDPLSMVEPSQGRSPSYAS

Compound 14
(SEQ ID NO: 114)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGHKSRDPAPRGPARFLPLPGLPPA

PPEPPGILAPQPPDVGSSDPLSMVGPSQGRSPSYAS

Compound 15
(SEQ ID NO: 115)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGHKSRDPAPRGPARFLPLPGLPPA

PPEPPGILAPQPPDVGSSDPLSMVEPSQGREPSYAS

Compound 16
(SEQ ID NO: 116)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGHKSRDPAPRGPARFLPLPGLPPA

PPEPPGILAPQPPDVGSSDPLSMVPSQGRSPSYAS

Compound 17
(SEQ ID NO: 117)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGHKSRDPAPRGPARFLPLPGLPPA

PPEPPGILAPQPPDVGSSDPLSMVGSQGRSPSYAS

Compound 18
(SEQ ID NO: 118)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGNKSPHRDPAPRGPARFLPLPGLP

PAPPEPPGILAPQPPDVGSSDPLSMVEP

-continued

Compound 19
(SEQ ID NO: 119)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGSGPHRDPAPRGPARFLPLPGLPPA

PPEPPGILAPQPPDVGSSDPLSMVEPSQGRSPSYAS

Compound 20
(SEQ ID NO: 120)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGGHRDPAPRGPARFLPLPGLPPAPP

EPPGILAPQPPDVGSSDPLSMVEPSQGRSPSYAS

Compound 21
(SEQ ID NO: 121)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGSGRDPAPRGPARFLPLPGLPPAPP

EPPGILAPQPPDVGSSDPLSMVEPSQGRSPSYAS

Compound 22
(SEQ ID NO: 122)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGGPAPRGPARFLPLPGLPPAPPEP

PGILAPQPPDVGSSDPLSMVEPSQGRSPSYAS

Compound 23
(SEQ ID NO: 123)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGGGPARFLPLPGLPPAPPEPPGILA

PQPPDVGSSDPLSMVEPSQGRSPSYAS

Compound 24
(SEQ ID NO: 124)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPGGRFLPLPGLPPAPPEPPGILAPQ

PPDVGSSDPLSMVEPSQGRSPSYAS

Compound 25
(SEQ ID NO: 125)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLPSGGRFLPLPGLPPAPPEPPGILAP

QPPDVGSSDPLSMVEPSQGRSPSYAS

Compound 26
(SEQ ID NO: 126)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHSGGPAPRGPARFLPLPGLPPAPPEPP

GILAPQPPDVGSSDPLSMVEPSQGRSPSYAS

Compound 27
(SEQ ID NO: 127)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHGSGPARFLPLPGLPPAPPEPPGILA

PQPPDVGSSDPLSMVEPSQGRSPSYAS

Compound 28
(SEQ ID NO: 128)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPHGGRFLPLPGLPPAPPEPPGILAPQPPD

VGSSDPLSMVEPSQGRSPSYAS

-continued

Compound 29
(SEQ ID NO: 129)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPHSGGRFLPLPGLPPAPPEPPGILAPQPP

DVGSSDPLSMVEPSQGRSPSYAS

Compound 30
(SEQ ID NO: 130)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPHGSGRFLPLPGLPPAPPEPPGILAPQPP

DVGSSDPLSMVEPSQGRSPSYAS

Compound 31
(SEQ ID NO: 131)
MHPIPDSSPLLQFGGQVRQRYLYTDDAQQTEAHLEIREDGTVGGAADQSPESLLQLKALKPGVIQILGVKTS

RFLCQRPDGALYGSLHFDPEACSFRELLLEDGYNVYQSEAHGLPLHLGSGGPARFLPLPGLPPAPPEPPGIL

APQPPDVGSSDPLSMVTPSQGRSPSYAS

Compound 32
(SEQ ID NO: 132)
MHHHHHHPIPDSSPLLQFGGQVRQRYLYTDDAQQTEAHLEIREDGTVGGAADQSPESLLQLKALKPGVIQIL

GVKTSRFLCQRPDGALYGSLHFDPEACSFRELLLEDGYNVYQSEAHGLPLHLPGNKSPHRDPAPRGPARFLP

LPGLPPALPEPPGILAPQPPDVGSSDPLSMVGPSQGRSPSYAS

Pegylated Compound 1
(SEQ ID NO: 201)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLPGNKSPHRDPAPRGPARFLPL

PGLPPAPPEPPGILAPQPPDVGSSDPLSMVGPSQGRSPSYAS

Pegylated Compound 2
(SEQ ID NO: 202)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGSGRGPARFLPLPGLPPAPPE

PPGILAPQPPDVGSSDPLSMVEPSQGRSPSYAS

Pegylated Compound 5
(SEQ ID NO: 205)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLPGDKSRDPAPRGPARFLPLPG

LPPAPPEPPGILAPQPPDVGSSDPLSMVEPSQGRSPSYAS

Pegylated Compound 6
(SEQ ID NO: 206)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLPGHKSRDPAPRGPARFLPLPG

LPPAPPEPPGILAPQPPDVGSSDPLSMVEPSQGRSPSYAS

Pegylated Compound 10
(SEQ ID NO: 210)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGSGGPARFLPLPGLPPAPPEP

PGILAPQPPDVGSSDPLSMVEPSQGRSPSYAS

Pegylated Compound 11
(SEQ ID NO: 211)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGSGHRDPAPRGPARFLPLPGL

PPAPPEPPGILAPQPPDVGSSDPLSMVEPSQGRSPSYAS

-continued

Pegylated Compound 12
(SEQ ID NO: 212)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLPHHSGRDPAPRGPARFLPLPG

LPPAPPEPPGILAPQPPDVGSSDPLSMVEPSQGRSPSYAS

Pegylated Compound 19
(SEQ ID NO: 219)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGSGPHRDPAPRGPARFLPLPG

LPPAPPEPPGILAPQPPDVGSSDPLSMVEPSQGRSPSYAS

Pegylated Compound 20
(SEQ ID NO: 220)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGGHRDPAPRGPARFLPLPGLP

PAPPEPPGILAPQPPDVGSSDPLSMVEPSQGRSPSYAS

Pegylated Compound 21
(SEQ ID NO: 221)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGSGRDPAPRGPARFLPLPGLP

PAPPEPPGILAPQPPDVGSSDPLSMVEPSQGRSPSYAS

Pegylated Compound 22
(SEQ ID NO: 222)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLSGGPAPRGPARFLPLPGLPPA

PPEPPGILAPQPPDVGSSDPLSMVEPSQGRSPSYAS

Pegylated Compound 23
(SEQ ID NO: 223)
MHPIPDSSPLLQFGGQVRQRYLYTDDAQQTEAHLEIREDGTVGGAADQSPESLLQLKALKPGVIQILGVKTS RFLCQRPDGALYGSLHFDPEACSFRELLLEDGYNVY(pAF)SEAHGLPLHLGGGPARFLPLPGLPPAPPEPP

GILAPQPPDVGSSDPLSMVEPSQGRSPSYAS

Additional modified FGF-21 polypeptides were produced as fusion proteins. Some of the modified FGF-21 polypeptides contained the sequence of Compound 2 (SEQ ID NO:102), with or without the N-terminal methionine, fused to one or more fusion partners, such as an Fc domain or fragment thereof, a PKE Adnectin ("PKE"), or modified or unmodified human serum albumin ("HSA") sequence and optionally a connecting peptide. Other modified FGF-21 polypeptides were based upon a wild-type sequence of Compound 1 (with or without the N-terminal methionine). Different PKE Adnectin sequence forms were included. These are referred to as "PKE(1)" or "PKEI" and "PKE(2)" or PKEII. The amino acid sequence of PKE(1) was GVSDVPRDLEVVAATPTSLLISWHSYYEQNSYYRITYGETGGNSPVQEFTVPYSQTTATISGLKPGVDYTITVYAVYGSKYYYPISINYRTEIEKPSQ (SEQ ID NO:319). The amino acid sequence of PKE(2) was GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTP (SEQ ID NO:320). When PKE(1) or PKE(2) was included at the N-terminus of the fusion protein, the sequence expressed in E. coli included an N-terminal methionine, which was expected to be cleaved by a met-exopeptidase when expressed in E. coli, resulting in a mature sequence without the N-terminal methionine; the expected mature form of the PKE fusion proteins without the N-terminal methionine is shown in the list below.

A human serum albumin sequence contained in some of the fusion proteins was HuSA(C34A). Its amino acid sequence is:

(SEQ ID NO: 321)
DAHKSEVAHRFKDLGEENFKALVLIAFAQYLQQAPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGL.

Another human serum albumin sequence contained in some of the fusion proteins was HSA (C34A, des Leu-585). Its amino acid sequence is:

(SEQ ID NO: 322)
DAHKSEVAHRFKDLGEENFKALVLIAFAQYLQQAPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALG.

G4Sx3 refers to the sequence GGGGS (SEQ ID NO: 355) repeated 3 times, i.e., GGGGSGGGGSGGGGS (SEQ ID NO: 359).

Exemplary fusion proteins contained more than one modified FGF-21 polypeptide, e.g., Compounds 141-146.

The sequences of the fusion protein compounds are shown below, and features of these fusion proteins are summarized in FIG. 40A-C.

```
Compound 101: PKE(2)-L1-FGF21 (Compound 2)
                                                                (SEQ ID NO: 401)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPGSHPIPDSSPLLQFGGQVRQRYLYTDDAQQTEAHLEIREDGTVG

GAADQSPESLLQLKALKPGVIQILGVKTSRFLCQRPDGALYGSLHFDPEACSFRELLLEDGYNVYQSEAHGLP

LHLGSGRGPARFLPLPGLPPAPPEPPGILAPQPPDVGSSDPLSMVEPSQGRSPSYAS

Compound 102: PKE(2)-L2-FGF21 (Compound 2)
                                                                (SEQ ID NO: 402)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPGGGGSHPIPDSSPLLQFGGQVRQRYLYTDDAQQTEAHLEIREDG

TVGGAADQSPESLLQLKALKPGVIQILGVKTSRFLCQRPDGALYGSLHFDPEACSFRELLLEDGYNVYQSEAH

GLPLHLGSGRGPARFLPLPGLPPAPPEPPGILAPQPPDVGSSDPLSMVEPSQGRSPSYAS

Compound 103: PKE(2)-L3-FGF21 (Compound 2)
                                                                (SEQ ID NO: 403)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPEEEEDEEEEDHPIPDSSPLLQFGGQVRQRYLYTDDAQQTEAHLEI

REDGTVGGAADQSPESLLQLKALKPGVIQILGVKTSRFLCQRPDGALYGSLHFDPEACSFRELLLEDGYNVYQ

SEAHGLPLHLGSGRGPARFLPLPGLPPAPPEPPGILAPQPPDVGSSDPLSMVEPSQGRSPSYAS

Compound 104: PKE(2)-L4-FGF21 (Compound 2)
                                                                (SEQ ID NO: 404)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPPTPEPHPIPDSSPLLQFGGQVRQRYLYTDDAQQTEAHLEIR

EDGTVGGAADQSPESLLQLKALKPGVIQILGVKTSRFLCQRPDGALYGSLHFDPEACSFRELLLEDGYNVYQS

EAHGLPLHLGSGRGPARFLPLPGLPPAPPEPPGILAPQPPDVGSSDPLSMVEPSQGRSPSYAS

Compound 105: PKE(2)-L5-FGF21 (Compound 2)
                                                                (SEQ ID NO: 405)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPGSHHHHHHHGSHPIPDSSPLLQFGGQVRQRYLYTDDAQQTEA

HLEIREDGTVGGAADQSPESLLQLKALKPGVIQILGVKTSRFLCQRPDGALYGSLHFDPEACSFRELLLEDGY

NVYQSEAHGLPLHLGSGRGPARFLPLPGLPPAPPEPPGILAPQPPDVGSSDPLSMVEPSQGRSPSYAS

Compound 106: PKE(2)-L6-FGF21 (Compound 2)
                                                                (SEQ ID NO: 406)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPGGGGSGGGGSGGGGSHPIPDSSPLLQFGGQVRQRYLYTDDAQQ

TEAHLEIREDGTVGGAADQSPESLLQLKALKPGVIQILGVKTSRFLCQRPDGALYGSLHFDPEACSFRELLLED

GYNVYQSEAHGLPLHLGSGRGPARFLPLPGLPPAPPEPPGILAPQPPDVGSSDPLSMVEPSQGRSPSYAS
```

-continued

Compound 107: PKE(2)-L7-FGF21 (Compound 2) (SEQ ID NO: 407)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPGGGGSGGGSGGGGSHPIPDSSPLLQFGGQVRQRYLYTDDAQQ
TEAHLEIREDGTVGGAADQSPESLLQLKALKPGVIQILGVKTSRFLCQRPDGALYGSLHFDPEACSFRELLLED
GYNVYQSEAHGLPLHLGSGRGPARFLPLPGLPPAPPEPPGILAPQPPDVGSSDPLSMVEPSQGRSPSYAS

Compound 108: PKE(2)-L8-FGF21 (Compound 2) (SEQ ID NO: 408)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPGSGSGSGSGSGSGSHPIPDSSPLLQFGGQVRQRYLYTDDAQQT
EAHLEIREDGTVGGAADQSPESLLQLKALKPGVIQILGVKTSRFLCQRPDGALYGSLHFDPEACSFRELLLEDG
YNVYQSEAHGLPLHLGSGRGPARFLPLPGLPPAPPEPPGILAPQPPDVGSSDPLSMVEPSQGRSPSYAS

Compound 109: PKE(2)-L9-FGF21 (Compound 2) (SEQ ID NO: 409)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPPSTPPTPSPSTPPTPSPSHPIPDSSPLLQFGGQVRQRYLYTDDAQQT
EAHLEIREDGTVGGAADQSPESLLQLKALKPGVIQILGVKTSRFLCQRPDGALYGSLHFDPEACSFRELLLEDG
YNVYQSEAHGLPLHLGSGRGPARFLPLPGLPPAPPEPPGILAPQPPDVGSSDPLSMVEPSQGRSPSYAS

Compound 110: PKE(2)-L10-FGF21 (Compound 2) (SEQ ID NO: 410)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPRGGEEKKKEKEKEEQEERETKTPHPIPDSSPLLQFGGQVRQRYL
YTDDAQQTEAHLEIREDGTVGGAADQSPESLLQLKALKPGVIQILGVKTSRFLCQRPDGALYGSLHFDPEACS
FRELLLEDGYNVYQSEAHGLPLHLGSGRGPARFLPLPGLPPAPPEPPGILAPQPPDVGSSDPLSMVEPSQGRSPS
YAS

Compound 111: PKE(2)-L11-FGF21 (Compound 2) (SEQ ID NO: 411)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPGGGSGGGGSGGGGSGGGGSGGGGSHPIPDSSPLLQFGGQVRQ
RYLYTDDAQQTEAHLEIREDGTVGGAADQSPESLLQLKALKPGVIQILGVKTSRFLCQRPDGALYGSLHFDPE
ACSFRELLLEDGYNVYQSEAHGLPLHLGSGRGPARFLPLPGLPPAPPEPPGILAPQPPDVGSSDPLSMVEPSQG
RSPSYAS

Compound 112: PKE(2)-L12-FGF21 (Compound 2) (SEQ ID NO: 412)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPPSPEPPTPEPPSPEPPTPEPPSPEPPTPEPHPIPDSSPLLQFGGQVRQ
RYLYTDDAQQTEAHLEIREDGTVGGAADQSPESLLQLKALKPGVIQILGVKTSRFLCQRPDGALYGSLHFDPE
ACSFRELLLEDGYNVYQSEAHGLPLHLGSGRGPARFLPLPGLPPAPPEPPGILAPQPPDVGSSDPLSMVEPSQG
RSPSYAS

Compound 113: PKE(2)-L13-FGF21 (Compound 2) (SEQ ID NO: 413)

GVSDVPRDLEVVAATPTSLLISWDAPAVTVRYYRITYGREVQKYSDLGPLYIYQEFTVPGSKSTATISGLKPG
VDYTITVYAVTGSGESPASSKPISINYRTPPSTPPTPSPSTPPTPSPSPSTPPTPSPSTPPTPSPSHPIPDSSPLLQFGG
QVRQRYLYTDDAQQTEAHLEIREDGTVGGAADQSPESLLQLKALKPGVIQILGVKTSRFLCQRPDGALYGSL
HFDPEACSFRELLLEDGYNVYQSEAHGLPLHLGSGRGPARFLPLPGLPPAPPEPPGILAPQPPDVGSSDPLSMV
EPSQGRSPSYAS

-continued

Compound 114: PKE(2)-L14-FGF21 (Compound 2)
(SEQ ID NO: 414)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPHPIPDSSPLLQFGGQVRQRYLYTDDAQQTEAHLEIREDGT

VGGAADQSPESLLQLKALKPGVIQILGVKTSRFLCQRPDGALYGSLHFDPEACSFRELLLEDGYNVYQSEAHG

LPLHLGSGRGPARFLPLPGLPPAPPEPPGILAPQPPDVGSSDPLSMVEPSQGRSPSYAS

Compound 115: PKE(2)-L15-FGF21 (Compound 2)
(SEQ ID NO: 415)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPPTPEPPSPEPPTPEPHPIPDSSPLLQFGGQVRQRYLYTDDAQ

QTEAHLEIREDGTVGGAADQSPESLLQLKALKPGVIQILGVKTSRFLCQRPDGALYGSLHFDPEACSFRELLLE

DGYNVYQSEAHGLPLHLGSGRGPARFLPLPGLPPAPPEPPGILAPQPPDVGSSDPLSMVEPSQGRSPSYAS

Compound 116: PKE(2)-L16-FGF21 (Compound 2)
(SEQ ID NO: 416)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPPTPEPPSPEPPTPEPPSPEPPTPEPPSPEPPTPEPHPIPDSSPLL

QFGGQVRQRYLYTDDAQQTEAHLEIREDGTVGGAADQSPESLLQLKALKPGVIQILGVKTSRFLCQRPDGAL

YGSLHFDPEACSFRELLLEDGYNVYQSEAHGLPLHLGSGRGPARFLPLPGLPPAPPEPPGILAPQPPDVGSSDPL

SMVEPSQGRSPSYAS

Compound 117: PKE(2)-L17-FGF21 (Compound 2)
(SEQ ID NO: 417)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPTPEPPSPEPPTPEPPSPEPHPIPDSSPLLQFGGQVRQRYLYTDDAQ

QTEAHLEIREDGTVGGAADQSPESLLQLKALKPGVIQILGVKTSRFLCQRPDGALYGSLHFDPEACSFRELLLE

DGYNVYQSEAHGLPLHLGSGRGPARFLPLPGLPPAPPEPPGILAPQPPDVGSSDPLSMVEPSQGRSPSYAS

Compound 118: PKE(2)-L18-FGF21 (Compound 2)
(SEQ ID NO: 418)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPGGGSPTPEPHPIPDSSPLLQFGGQVRQRYLYTDDAQQTEA

HLEIREDGTVGGAADQSPESLLQLKALKPGVIQILGVKTSRFLCQRPDGALYGSLHFDPEACSFRELLLEDGY

NVYQSEAHGLPLHLGSGRGPARFLPLPGLPPAPPEPPGILAPQPPDVGSSDPLSMVEPSQGRSPSYAS

Compound 119: PKE(2)-L19-FGF21 (Compound 2)
(SEQ ID NO: 419)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPEEEDPTPEPHPIPDSSPLLQFGGQVRQRYLYTDDAQQTEA

HLEIREDGTVGGAADQSPESLLQLKALKPGVIQILGVKTSRFLCQRPDGALYGSLHFDPEACSFRELLLEDGY

NVYQSEAHGLPLHLGSGRGPARFLPLPGLPPAPPEPPGILAPQPPDVGSSDPLSMVEPSQGRSPSYAS

Compound 120: PKE(2)-L20-FGF21 (Compound 2)
(SEQ ID NO: 420)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPPTPEPEEEDPSPEPPTPEPHPIPDSSPLLQFGGQVRQRYLYT

DDAQQTEAHLEIREDGTVGGAADQSPESLLQLKALKPGVIQILGVKTSRFLCQRPDGALYGSLHFDPEACSFR

ELLLEDGYNVYQSEAHGLPLHLGSGRGPARFLPLPGLPPAPPEPPGILAPQPPDVGSSDPLSMVEPSQGRSPSY

AS

Compound 121: PKE(2)-L21-FGF21 (Compound 2)
(SEQ ID NO: 421)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPTPEPPSPEPPTPEPEEEDPSPEPPTPEPPSPEPHPIPDSSPLLQFGGQ

VRQRYLYTDDAQQTEAHLEIREDGTVGGAADQSPESLLQLKALKPGVIQILGVKTSRFLCQRPDGALYGSLH

FDPEACSFRELLLEDGYNVYQSEAHGLPL HLGSGRGPARFLPLPGLPPAPPEPPGILAPQPPDVGSSDPLSMVEP

SQGRSPSYAS

Compound 122: PKE(2)-L22-FGF21 (Compound 2)
(SEQ ID NO: 422)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPTPEPPSPEPPTPEPGGGGSPSPEPPTPEPPSPEPHPIPDSSPLLQFGG

QVRQRYLYTDDAQQTEAHLEIREDGTVGGAADQSPESLLQLKALKPGVIQILGVKTSRFLCQRPDGALYGSL

HFDPEACSFRELLLEDGYNVYQSEAHGLPLHLGSGRGPARFLPLPGLPPAPPEPPGILAPQPPDVGSSDPLSMV

EPSQGRSPSYAS

Compound 123: PKE(2)-L23-FGF21 (Compound 2)
(SEQ ID NO: 423)
GVSDVPRDLEVVAATPTSLLISWDAPAVTVRYYRITYGREVQKYSDLGPLYIYQEFTVPGSKSTATISGLKPG

VDYTITVYAVTGSGESPASSKPISINYRTPPSPEPTPEPSPEPPTPEPSPEPTPEPHPIPDSSPLLQFGGQVRQRYLY

TDDAQQTEAHLEIREDGTVGGAADQSPESLLQLKALKPGVIQILGVKTSRFLCQRPDGALYGSLHFDPEACSF

RELLLEDGYNVYQSEAHGLPLHLGSGRGPARFLPLPGLPPAPPEPPGILAPQPPDVGSSDPLSMVEPSQGRSPS

YAS

Compound 124: HuSA(C34A)-L201-FGF21 (Compound 2)
(SEQ ID NO: 424)
DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGLGSHPIPDSSPLLQFGGQVRQRYLYTDDAQQTEAHLEIREDGTVGGAADQSPESLLQLK

ALKPGVIQILGVKTSRFLCQRPDGALYGSLHFDPEACSFRELLLEDGYNVYQSEAHGLPLHLGSGRGPARFLP

LPGLPPAPPEPPGILAPQPPDVGSSDPLSMVEPSQERSPSYAS

Compound 125: HuSA(C34A)-L202-FGF21 (Compound 2)
(SEQ ID NO: 425)
DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

-continued

GKKLVAASQAALGLGGGGSHPIPDSSPLLQFGGQVRQRYLYTDDAQQTEAHLEIREDGTVGGAADQSPESLL

QLKALKPGVIQILGVKTSRFLCQRPDGALYGSLHFDPEACSFRELLLEDGYNVYQSEAHGLPLHLGSGRGPAR

FLPLPGLPPAPPEPPGILAPQPPDVGSSDPLSMVEPSQERSPSYAS

Compound 126: HuSA(C34A)-L203-FGF21 (Compound 2)

(SEQ ID NO: 426)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGLGETGSHPIPDSSPLLQFGGQVRQRYLYTDDAQQTEAHLEIREDGTVGGAADQSPESLL

QLKALKPGVIQILGVKTSRFLCQRPDGALYGSLHFDPEACSFRELLLEDGYNVYQSEAHGLPLHLGSGRGPAR

FLPLPGLPPAPPEPPGILAPQPPDVGSSDPLSMVEPSQERSPSYAS

Compound 127: HuSA(C34A)-L204-FGF21 (Compound 2)

(SEQ ID NO: 427)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGLGGGGSGGGGSHPIPDSSPLLQFGGQVRQRYLYTDDAQQTEAHLEIREDGTVGGAADQ

SPESLLQLKALKPGVIQILGVKTSRFLCQRPDGALYGSLHFDPEACSFRELLLEDGYNVYQSEAHGLPLHLGSG

RGPARFLPLPGLPPAPPEPPGILAPQPPDVGSSDPLSMVEPSQERSPSYAS

Compound 128: HuSA(C34A)-L205-FGF21 (Compound 2)

(SEQ ID NO: 428)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGLGETGSSGEGTHPIPDSSPLLQFGGQVRQRYLYTDDAQQTEAHLEIREDGTVGGAADQS

PESLLQLKALKPGVIQILGVKTSRFLCQRPDGALYGSLHFDPEACSFRELLLEDGYNVYQSEAHGLPLHLGSG

RGPARFLPLPGLPPAPPEPPGILAPQPPDVGSSDPLSMVEPSQERSPSYAS

-continued

Compound 129: HuSA(C34A)-L206-FGF21 (Compound 2) (SEQ ID NO: 429)

DAHKSEVAHRFKDLGEENFKALVLIAFAQYLQQAPFEDHVKLVNEVTEFAKTCVADESAENCDKSLHTLFG
DKLCTVATLRETYGEMADCCAKQEPERNECFLQHKDDNPNLPRLVRPEVDVMCTAFHDNEETFLKKYLYEI
ARRHPYFYAPELLFFAKRYKAAFTECCQAADKAACLLPKLDELRDEGKASSAKQRLKCASLQKFGERAFKA
WAVARLSQRFPKAEFAEVSKLVTDLTKVHTECCHGDLLECADDRADLAKYICENQDSISSKLKECCEKPLLE
KSHCIAEVENDEMPADLPSLAADFVESKDVCKNYAEAKDVFLGMFLYEYARRHPDYSVVLLLRLAKTYETT
LEKCCAAADPHECYAKVFDEFKPLVEEPQNLIKQNCELFEQLGEYKFQNALLVRYTKKVPQVSTPTLVEVSR
NLGKVGSKCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADDKETCFAEE
GKKLVAASQAALGLGGGSGGGGSGGGGSHPIPDSSPLLQFGGQVRQRYLYTDDAQQTEAHLEIREDGTVG
GAADQSPESLLQLKALKPGVIQILGVKTSRFLCQRPDGALYGSLHFDPEACSFRELLLEDGYNVYQSEAHGLP
LHLGSGRGPARFLPLPGLPPAPPEPPGILAPQPPDVGSSDPLSMVEPSQERSPSYAS

Compound 130: HuSA(C34A)-L207-FGF21 (Compound 2) (SEQ ID NO: 430)

DAHKSEVAHRFKDLGEENFKALVLIAFAQYLQQAPFEDHVKLVNEVTEFAKTCVADESAENCDKSLHTLFG
DKLCTVATLRETYGEMADCCAKQEPERNECFLQHKDDNPNLPRLVRPEVDVMCTAFHDNEETFLKKYLYEI
ARRHPYFYAPELLFFAKRYKAAFTECCQAADKAACLLPKLDELRDEGKASSAKQRLKCASLQKFGERAFKA
WAVARLSQRFPKAEFAEVSKLVTDLTKVHTECCHGDLLECADDRADLAKYICENQDSISSKLKECCEKPLLE
KSHCIAEVENDEMPADLPSLAADFVESKDVCKNYAEAKDVFLGMFLYEYARRHPDYSVVLLLRLAKTYETT
LEKCCAAADPHECYAKVFDEFKPLVEEPQNLIKQNCELFEQLGEYKFQNALLVRYTKKVPQVSTPTLVEVSR
NLGKVGSKCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADDKETCFAEE
GKKLVAASQAALGLGETGSSGEGTGSTGSHPIPDSSPLLQFGGQVRQRYLYTDDAQQTEAHLEIREDGTVGG
AADQSPESLLQLKALKPGVIQILGVKTSRFLCQRPDGALYGSLHFDPEACSFRELLLEDGYNVYQSEAHGLPL
HLGSGRGPARFLPLPGLPPAPPEPPGILAPQPPDVGSSDPLSMVEPSQERSPSYAS

Compound 131: HuSA(C34A)-L208-FGF21 (Compound 2) (SEQ ID NO: 431)

DAHKSEVAHRFKDLGEENFKALVLIAFAQYLQQAPFEDHVKLVNEVTEFAKTCVADESAENCDKSLHTLFG
DKLCTVATLRETYGEMADCCAKQEPERNECFLQHKDDNPNLPRLVRPEVDVMCTAFHDNEETFLKKYLYEI
ARRHPYFYAPELLFFAKRYKAAFTECCQAADKAACLLPKLDELRDEGKASSAKQRLKCASLQKFGERAFKA
WAVARLSQRFPKAEFAEVSKLVTDLTKVHTECCHGDLLECADDRADLAKYICENQDSISSKLKECCEKPLLE
KSHCIAEVENDEMPADLPSLAADFVESKDVCKNYAEAKDVFLGMFLYEYARRHPDYSVVLLLRLAKTYETT
LEKCCAAADPHECYAKVFDEFKPLVEEPQNLIKQNCELFEQLGEYKFQNALLVRYTKKVPQVSTPTLVEVSR
NLGKVGSKCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADDKETCFAEE
GKKLVAASQAALGLGGGSGGGGSGGGGSGGGGSHPIPDSSPLLQFGGQVRQRYLYTDDAQQTEAHLEIRE
DGTVGGAADQSPESLLQLKALKPGVIQILGVKTSRFLCQRPDGALYGSLHFDPEACSFRELLLEDGYNVYQSE
AHGLPLHLGSGRGPARFLPLPGLPPAPPEPPGILAPQPPDVGSSDPLSMVEPSQERSPSYAS

Compound 132: HuSA(C34A)-L209-FGF21 (Compound 2) (SEQ ID NO: 432)

DAHKSEVAHRFKDLGEENFKALVLIAFAQYLQQAPFEDHVKLVNEVTEFAKTCVADESAENCDKSLHTLFG
DKLCTVATLRETYGEMADCCAKQEPERNECFLQHKDDNPNLPRLVRPEVDVMCTAFHDNEETFLKKYLYEI
ARRHPYFYAPELLFFAKRYKAAFTECCQAADKAACLLPKLDELRDEGKASSAKQRLKCASLQKFGERAFKA
WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGLGETGSSGEGTGSTGSGAGESHPIPDSSPLLQFGGQVRQRYLYTDDAQQTEAHLEIRED

GTVGGAADQSPESLLQLKALKPGVIQILGVKTSRFLCQRPDGALYGSLHFDPEACSFRELLLEDGYNVYQSEA

HGLPLHLGSGRGPARFLPLPGLPPAPPEPPGILAPQPPDVGSSDPLSMVEPSQERSPSYAS

Compound 133: HuSA(C34A, des Leu-585)-L211-FGF21 (Compound 2) (SEQ ID NO: 434)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGGGGSGGGGSGGGGSHPIPDSSPLLQFGGQVRQRYLYTDDAQQTEAHLEIREDGTVGG

AADQSPESLLQLKALKPGVIQILGVKTSRFLCQRPDGALYGSLHFDPEACSFRELLLEDGYNVYQSEAHGLPL

HLGSGRGPARFLPLPGLPPAPPEPPGILAPQPPDVGSSDPLSMVEPSQERSPSYAS

Compound 134: HuSA(C34A, des Leu-585)-L207-FGF21 (Compound 2) (SEQ ID NO: 435)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGGETGSSGEGTGSTGSHPIPDSSPLLQFGGQVRQRYLYTDDAQQTEAHLEIREDGTVGGA

ADQSPESLLQLKALKPGVIQILGVKTSRFLCQRPDGALYGSLHFDPEACSFRELLLEDGYNVYQSEAHGLPH

LGSGRGPARFLPLPGLPPAPPEPPGILAPQPPDVGSSDPLSMVEPSQERSPSYAS

Compound 135: HuSA(C34A, des Leu-585)-L211-FGF21 (Compound 1) (SEQ ID NO: 436)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGGGGSGGGGSGGGGSHPIPDSSPLLQFGGQVRQRYLYTDDAQQTEAHLEIREDGTVGG

AADQSPESLLQLKALKPGVIQILGVKTSRFLCQRPDGALYGSLHFDPEACSFRELLLEDGYNVYQSEAHGLPL

HLPGNKSPHRDPAPRGPARFLPLPGLPPAPPEPPGILAPQPPDVGSSDPLSMVGPSQGRSPSYAS

Compound 136: HuSA(C34A, des Leu-585)-L207-FGF21 (Compound 1) (SEQ ID NO: 437)

DAHKSEVAHRFKDLGEENFKALVLIAFAQYLQQAPFEDHVKLVNEVTEFAKTCVADESAENCDKSLHTLFG

DKLCTVATLRETYGEMADCCAKQEPERNECFLQHKDDNPNLPRLVRPEVDVMCTAFHDNEETFLKKYLYEI

ARRHPYFYAPELLFFAKRYKAAFTECCQAADKAACLLPKLDELRDEGKASSAKQRLKCASLQKFGERAFKA

WAVARLSQRFPKAEFAEVSKLVTDLTKVHTECCHGDLLECADDRADLAKYICENQDSISSKLKECCEKPLLE

KSHCIAEVENDEMPADLPSLAADFVESKDVCKNYAEAKDVFLGMFLYEYARRHPDYSVVLLLRLAKTYETT

LEKCCAAADPHECYAKVFDEFKPLVEEPQNLIKQNCELFEQLGEYKFQNALLVRYTKKVPQVSTPTLVEVSR

NLGKVGSKCCKHPEAKRMPCAEDYLSVVLNQLCVLHEKTPVSDRVTKCCTESLVNRRPCFSALEVDETYVP

KEFNAETFTFHADICTLSEKERQIKKQTALVELVKHKPKATKEQLKAVMDDFAAFVEKCCKADDKETCFAEE

GKKLVAASQAALGGETGSSGEGTGSTGSHPIPDSSPLLQFGGQVRQRYLYTDDAQQTEAHLEIREDGTVGGA

ADQSPESLLQLKALKPGVIQILGVKTSRFLCQRPDGALYGSLHFDPEACSFRELLLEDGYNVYQSEAHGLPH

LPGNKSPHRDPAPRGPARFLPLPGLPPAPPEPPGILAPQPPDVGSSDPLSMVGPSQGRSPSYAS

Compound 137: FGF 21 (Compound 2)-L205-HuSA(C34A)- (SEQ ID NO: 440)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPHLGSRGPARFLPLPGLPPAPPEPPGILAPQP

PDVGSSDPLSMVEPSQERSPSYASGETGSSGEGTDAHKSEVAHRFKDLGEENFKALVLIAFAQYLQQAPFEDH

VKLVNEVTEFAKTCVADESAENCDKSLHTLFGDKLCTVATLRETYGEMADCCAKQEPERNECFLQHKDDNP

NLPRLVRPEVDVMCTAFHDNEETFLKKYLYEIARRHPYFYAPELLFFAKRYKAAFTECCQAADKAACLLPKL

DELRDEGKASSAKQRLKCASLQKFGERAFKAWAVARLSQRFPKAEFAEVSKLVTDLTKVHTECCHGDLLEC

ADDRADLAKYICENQDSISSKLKECCEKPLLEKSHCIAEVENDEMPADLPSLAADFVESKDVCKNYAEAKDV

FLGMFLYEYARRHPDYSVVLLLRLAKTYETTLEKCCAAADPHECYAKVFDEFKPLVEEPQNLIKQNCELFEQ

LGEYKFQNALLVRYTKKVPQVSTPTLVEVSRNLGKVGSKCCKHPEAKRMPCAEDYLSVVLNQLCVLHEKTP

VSDRVTKCCTESLVNRRPCFSALEVDETYVPKEFNAETFTFHADICTLSEKERQIKKQTALVELVKHKPKATK

EQLKAVMDDFAAFVEKCCKADDKETCFAEEGKKLVAASQAALGL

Compound 138: FGF21 (Compound 2)-L209-HuSA(C34A)- (SEQ ID NO: 441)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPHLGSRGPARFLPLPGLPPAPPEPPGILAPQP

PDVGSSDPLSMVEPSQERSPSYASGETGSSGEGTGSTGSGAGESDAHKSEVAHRFKDLGEENFKALVLIAFAQ

YLQQAPFEDHVKLVNEVTEFAKTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFYAPELLFFAKRYKAAFTECCQAA

DKAACLLPKLDELRDEGKASSAKQRLKCASLQKFGERAFKAWAVARLSQRFPKAEFAEVSKLVTDLTKVHT

ECCHGDLLECADDRADLAKYICENQDSISSKLKECCEKPLLEKSHCIAEVENDEMPADLPSLAADFVESKDVC

KNYAEAKDVFLGMFLYEYARRHPDYSVVLLLRLAKTYETTLEKCCAAADPHECYAKVFDEFKPLVEEPQNL

IKQNCELFEQLGEYKFQNALLVRYTKKVPQVSTPTLVEVSRNLGKVGSKCCKHPEAKRMPCAEDYLSVVLN

QLCVLHEKTPVSDRVTKCCTESLVNRRPCFSALEVDETYVPKEFNAETFTFHADICTLSEKERQIKKQTALVEL

VKHKPKATKEQLKAVMDDFAAFVEKCCKADDKETCFAEEGKKLVAASQAALGL

Compound 139: FGF21 (Compound 2)-L210-HuSA(C34A)- (SEQ ID NO: 442)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPHLGSRGPARFLPLPGLPPAPPEPPGILAPQP

PDVGSSDPLSMVEPSQERSPSYASGETGSSGEGTGSTGSGAGESGTGESGEGGSDAHKSEVAHRFKDLGEENF

KALVLIAFAQYLQQAPFEDHVKLVNEVTEFAKTCVADESAENCDKSLHTLFGDKLCTVATLRETYGEMADC

CAKQEPERNECFLQHKDDNPNLPRLVRPEVDVMCTAFHDNEETFLKKYLYEIARRHPYFYAPELLFFAKRYK

AAFTECCQAADKAACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEVENDEMPADLPSLA

ADFVESKDVCKNYAEAKDVFLGMFLYEYARRHPDYSVVLLLRLAKTYETTLEKCCAAADPHECYAKVFDEF

KPLVEEPQNLIKQNCELFEQLGEYKFQNALLVRYTKKVPQVSTPTLVEVSRNLGKVGSKCCKHPEAKRMPCA

EDYLSVVLNQLCVLHEKTPVSDRVTKCCTESLVNRRPCFSALEVDETYVPKEFNAETFTFHADICTLSEKERQI

KKQTALVELVKHKPKATKEQLKAVMDDFAAFVEKCCKADDKETCFAEEGKKLVAASQAALGL

Compound 140: FGF21 (Compound 1)-L209-HuSA(C34A)- (SEQ ID NO: 443)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPLHLPGNKSPHRDPAPRGPARFLPLPGLPPAPP

EPPGILAPQPPDVGSSDPLSMVGPSQGRSPSYASGETGSSGEGTGSTGSGAGESDAHKSEVAHRFKDLGEENF

KALVLIAFAQYLQQAPFEDHVKLVNEVTEFAKTCVADESAENCDKSLHTLFGDKLCTVATLRETYGEMADC

CAKQEPERNECFLQHKDDNPNLPRLVRPEVDVMCTAFHDNEETFLKKYLYEIARRHPYFYAPELLFFAKRYK

AAFTECCQAADKAACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEVENDEMPADLPSLA

ADFVESKDVCKNYAEAKDVFLGMFLYEYARRHPDYSVVLLLRLAKTYETTLEKCCAAADPHECYAKVFDEF

KPLVEEPQNLIKQNCELFEQLGEYKFQNALLVRYTKKVPQVSTPTLVEVSRNLGKVGSKCCKHPEAKRMPCA

EDYLSVVLNQLCVLHEKTPVSDRVTKCCTESLVNRRPCFSALEVDETYVPKEFNAETFTFHADICTLSEKERQI

KKQTALVELVKHKPKATKEQLKAVMDDFAAFVEKCCKADDKETCFAEEGKKLVAASQAALGL

Compound 141: FGF21 (Compound 2)-L209-HuSA(C34A)-G4Sx3-FGF21 (Compound 2) (SEQ ID NO: 446)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPLHLGSRGPARFLPLPGLPPAPPEPPGILAPQP

PDVGSSDPLSMVEPSQERSPSYASGETGSSGEGTGSTGSGAGESDAHKSEVAHRFKDLGEENFKALVLIAFAQ

YLQQAPFEDHVKLVNEVTEFAKTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFYAPELLFFAKRYKAAFTECCQAA

DKAACLLPKLDELRDEGKASSAKQRLKCASLQKFGERAFKAWAVARLSQRFPKAEFAEVSKLVTDLTKVHT

ECCHGDLLECADDRADLAKYICENQDSISSKLKECCEKPLLEKSHCIAEVENDEMPADLPSLAADFVESKDVC

KNYAEAKDVFLGMFLYEYARRHPDYSVVLLLRLAKTYETTLEKCCAAADPHECYAKVFDEFKPLVEEPQNL

IKQNCELFEQLGEYKFQNALLVRYTKKVPQVSTPTLVEVSRNLGKVGSKCCKHPEAKRMPCAEDYLSVVLN

QLCVLHEKTPVSDRVTKCCTESLVNRRPCFSALEVDETYVPKEFNAETFTFHADICTLSEKERQIKKQTALVEL

VKHKPKATKEQLKAVMDDFAAFVEKCCKADDKETCFAEEGKKLVAASQAALGLGGGGSGGGGSGGGGSH

PIPDSSPLLQFGGQVRQRYLYTDDAQQTEAHLEIREDGTVGGAADQSPESLLQLKALKPGVIQILGVKTSRFLC

QRPDGALYGSLHFDPEACSFRELLLEDGYNVYQSEAHGLPLHLGSRGPARFLPLPGLPPAPPEPPGILAPQPP

DVGSSDPLSMVEPSQERSPSYAS

Compound 142: FGF21 (Compound 1)-L209-HuSA(C34A)-G4Sx3-FGF21 (Compound 1) (SEQ ID NO: 447)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPLHLPGNKSPHRDPAPRGPARFLPLPGLPPAPP

EPPGILAPQPPDVGSSDPLSMVGPSQGRSPSYASGETGSSGEGTGSTGSGAGESDAHKSEVAHRFKDLGEENF

KALVLIAFAQYLQQAPFEDHVKLVNEVTEFAKTCVADESAENCDKSLHTLFGDKLCTVATLRETYGEMADC

-continued

CAKQEPERNECFLQHKDDNPNLPRLVRPEVDVMCTAFHDNEETFLKKYLYEIARRHPYFYAPELLFFAKRYK

AAFTECCQAADKAACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEVENDEMPADLPSLA

ADFVESKDVCKNYAEAKDVFLGMFLYEYARRHPDYSVVLLLRLAKTYETTLEKCCAAADPHECYAKVFDEF

KPLVEEPQNLIKQNCELFEQLGEYKFQNALLVRYTKKVPQVSTPTLVEVSRNLGKVGSKCCKHPEAKRMPCA

EDYLSVVLNQLCVLHEKTPVSDRVTKCCTESLVNRRPCFSALEVDETYVPKEFNAETFTFHADICTLSEKERQI

KKQTALVELVKHKPKATKEQLKAVMDDFAAFVEKCCKADDKETCFAEEGKKLVAASQAALGLGGGGSGG

GGSGGGGSHPIPDSSPLLQFGGQVRQRYLYTDDAQQTEAHLEIREDGTVGGAADQSPESLLQLKALKPGVIQI

LGVKTSRFLCQRPDGALYGSLHFDPEACSFRELLLEDGYNVYQSEAHGLPLHLPGNKSPHRDPAPRGPARFLP

LPGLPPAPPEPPGILAPQPPDVGSSDPLSMVGPSQGRSPSYAS

Compound 143: FGF21 (Compound 2)-L209-HuSA(C34A, des Leu-585)-G4Sx3-FGF21
(Compound 2)
(SEQ ID NO: 448)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPLHLGSRGPARFLPLPGLPPAPPEPPGILAPQP

PDVGSSDPLSMVEPSQERSPSYASGETGSSGEGTGSTGSGAGESDAHKSEVAHRFKDLGEENFKALVLIAFAQ

YLQQAPFEDHVKLVNEVTEFAKTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFYAPELLFFAKRYKAAFTECCQAA

DKAACLLPKLDELRDEGKASSAKQRLKCASLQKFGERAFKAWAVARLSQRFPKAEFAEVSKLVTDLTKVHT

ECCHGDLLECADDRADLAKYICENQDSISSKLKECCEKPLLEKSHCIAEVENDEMPADLPSLAADFVESKDVC

KNYAEAKDVFLGMFLYEYARRHPDYSVVLLLRLAKTYETTLEKCCAAADPHECYAKVFDEFKPLVEEPQNL

IKQNCELFEQLGEYKFQNALLVRYTKKVPQVSTPTLVEVSRNLGKVGSKCCKHPEAKRMPCAEDYLSVVLN

QLCVLHEKTPVSDRVTKCCTESLVNRRPCFSALEVDETYVPKEFNAETFTFHADICTLSEKERQIKKQTALVEL

VKHKPKATKEQLKAVMDDFAAFVEKCCKADDKETCFAEEGKKLVAASQAALGGGGSGGGGSGGGGSHPI

PDSSPLLQFGGQVRQRYLYTDDAQQTEAHLEIREDGTVGGAADQSPESLLQLKALKPGVIQILGVKTSRFLCQ

RPDGALYGSLHFDPEACSFRELLLEDGYNVYQSEAHGLPLHLGSRGPARFLPLPGLPPAPPEPPGILAPQPPD

VGSSDPLSMVEPSQERSPSYAS

Compound 144: FGF21 (Compound 1 )-L209 -HuSA(C34A, des Leu-585)-G4Sx3-FGF21
(Compound 1)
(SEQ ID NO: 449)

HPIPDSSPLLQFGGQVRQRYLYTDDAQQTEAHLEIREDGTVGGAADQSPESLLQLKALKPGVIQILGVKTSRFL

CQRPDGALYGSLHFDPEACSFRELLLEDGYNVYQSEAHGLPLHLPGNKSPHRDPAPRGPARFLPLPGLPPAPP

EPPGILAPQPPDVGSSDPLSMVGPSQGRSPSYASGETGSSGEGTGSTGSGAGESDAHKSEVAHRFKDLGEENF

KALVLIAFAQYLQQAPFEDHVKLVNEVTEFAKTCVADESAENCDKSLHTLFGDKLCTVATLRETYGEMADC

CAKQEPERNECFLQHKDDNPNLPRLVRPEVDVMCTAFHDNEETFLKKYLYEIARRHPYFYAPELLFFAKRYK

AAFTECCQAADKAACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEVENDEMPADLPSLA

ADFVESKDVCKNYAEAKDVFLGMFLYEYARRHPDYSVVLLLRLAKTYETTLEKCCAAADPHECYAKVFDEF

KPLVEEPQNLIKQNCELFEQLGEYKFQNALLVRYTKKVPQVSTPTLVEVSRNLGKVGSKCCKHPEAKRMPCA

EDYLSVVLNQLCVLHEKTPVSDRVTKCCTESLVNRRPCFSALEVDETYVPKEFNAETFTFHADICTLSEKERQI

KKQTALVELVKHKPKATKEQLKAVMDDFAAFVEKCCKADDKETCFAEEGKKLVAASQAALGGGGSGGG

GSGGGGSHPIPDSSPLLQFGGQVRQRYLYTDDAQQTEAHLEIREDGTVGGAADQSPESLLQLKALKPGVIQIL

GVKTSRFLCQRPDGALYGSLHFDPEACSFRELLLEDGYNVYQSEAHGLPLHLPGNKSPHRDPAPRGPARFLPL

PGLPPAPPEPPGILAPQPPDVGSSDPLSMVGPSQGRSPSYAS

-continued

Compound 145: FGF21 (Compound 2)-L210-HuSA(C34A)-G4Sx3-FGF21 (Compound 2) (SEQ ID NO: 450)

HPIPDSSPLLQFGGQVRQRYLYTDDAQQTEAHLEIREDGTVGGAADQSPESLLQLKALKPGVIQILGVKTSRFL
CQRPDGALYGSLHFDPEACSFRELLLEDGYNVYQSEAHGLPLHLGSRGPARFLPLPGLPPAPPEPPGILAPQP
PDVGSSDPLSMVEPSQERSPSYASGETGSSGEGTGSTGSGAGESGTGESGEGGSDAHKSEVAHRFKDLGEENF
KALVLIAFAQYLQQAPFEDHVKLVNEVTEFAKTCVADESAENCDKSLHTLFGDKLCTVATLRETYGEMADC
CAKQEPERNECFLQHKDDNPNLPRLVRPEVDVMCTAFHDNEETFLKKYLYEIARRHPYFYAPELLFFAKRYK
AAFTECCQAADKAACLLPKLDELRDEGKASSAKQRLKCASLQKFGERAFKAWAVARLSQRFPKAEFAEVSK
LVTDLTKVHTECCHGDLLECADDRADLAKYICENQDSISSKLKECCEKPLLEKSHCIAEVENDEMPADLPSLA
ADFVESKDVCKNYAEAKDVFLGMFLYEYARRHPDYSVVLLLRLAKTYETTLEKCCAAADPHECYAKVFDEF
KPLVEEPQNLIKQNCELFEQLGEYKFQNALLVRYTKKVPQVSTPTLVEVSRNLGKVGSKCCKHPEAKRMPCA
EDYLSVVLNQLCVLHEKTPVSDRVTKCCTESLVNRRPCFSALEVDETYVPKEFNAETFTFHADICTLSEKERQI
KKQTALVELVKHKPKATKEQLKAVMDDFAAFVEKCCKADDKETCFAEEGKKLVAASQAALGLGGGGSGG
GGSGGGGSHPIPDSSPLLQFGGQVRQRYLYTDDAQQTEAHLEIREDGTVGGAADQSPESLLQLKALKPGVIQI
LGVKTSRFLCQRPDGALYGSLHFDPEACSFRELLLEDGYNVYQSEAHGLPLHLGSRGPARFLPLPGLPPAPP
EPPGILAPQPPDVGSSDPLSMVEPSQERSPSYAS

Compound 146: FGF 21 (Compound 1)-L210-HuSA(C34A)-G4Sx3-FGF21 (Compound 1) (SEQ ID NO: 451)

HPIPDSSPLLQFGGQVRQRYLYTDDAQQTEAHLEIREDGTVGGAADQSPESLLQLKALKPGVIQILGVKTSRFL
CQRPDGALYGSLHFDPEACSFRELLLEDGYNVYQSEAHGLPLHLGNKSPHRDPAPRGPARFLPLPGLPPAPP
EPPGILAPQPPDVGSSDPLSMVGPSQGRSPSYASGETGSSGEGTGSTGSGAGESGTGESGEGGSDAHKSEVAH
RFKDLGEENFKALVLIAFAQYLQQAPFEDHVKLVNEVTEFAKTCVADESAENCDKSLHTLFGDKLCTVATLR
ETYGEMADCCAKQEPERNECFLQHKDDNPNLPRLVRPEVDVMCTAFHDNEETFLKKYLYEIARRHPYFYAP
ELLFFAKRYKAAFTECCQAADKAACLLPKLDELRDEGKASSAKQRLKCASLQKFGERAFKAWAVARLSQRF
PKAEFAEVSKLVTDLTKVHTECCHGDLLECADDRADLAKYICENQDSISSKLKECCEKPLLEKSHCIAEVEND
EMPADLPSLAADFVESKDVCKNYAEAKDVFLGMFLYEYARRHPDYSVVLLLRLAKTYETTLEKCCAAADPH
ECYAKVFDEFKPLVEEPQNLIKQNCELFEQLGEYKFQNALLVRYTKKVPQVSTPTLVEVSRNLGKVGSKCCK
HPEAKRMPCAEDYLSVVLNQLCVLHEKTPVSDRVTKCCTESLVNRRPCFSALEVDETYVPKEFNAETFTFHA
DICTLSEKERQIKKQTALVELVKHKPKATKEQLKAVMDDFAAFVEKCCKADDKETCFAEEGKKLVAASQAA
LGLGGGGSGGGGSGGGGSHPIPDSSPLLQFGGQVRQRYLYTDDAQQTEAHLEIREDGTVGGAADQSPESLLQ
LKALKPGVIQILGVKTSRFLCQRPDGALYGSLHFDPEACSFRELLLEDGYNVYQSEAHGLPLHLGNKSPHRD
PAPRGPARFLPLPGLPPAPPEPPGILAPQPPDVGSSDPLSMVGPSQGRSPSYAS

Compound 147: PKE(1)-L1-FGF21 (Compound 2) (SEQ ID NO: 452)

GVSDVPRDLEVVAATPTSLLISWHSYYEQNSYYRITYGETGGNSPVQEFTVPYSQTTATISGLKPGVDYTITVY
AVYGSKYYYPISINYRTEIEKPSQGSHPIPDSSPLLQFGGQVRQRYLYTDDAQQTEAHLEIREDGTVGGAADQS
PESLLQLKALKPGVIQILGVKTSRFLCQRPDGALYGSLHFDPEACSFRELLLEDGYNVYQSEAHGLPLHLGSG
RGPARFLPLPGLPPAPPEPPGILAPQPPDVGSSDPLSMVEPSQGRSPSYAS

Compound 148: PKE(1)-L2-FGF21 (Compound 2) (SEQ ID NO: 453)

GVSDVPRDLEVVAATPTSLLISWHSYYEQNSYYRITYGETGGNSPVQEFTVPYSQTTATISGLKPGVDYTITVY
AVYGSKYYYPISINYRTEIEKPSQGGGGSHPIPDSSPLLQFGGQVRQRYLYTDDAQQTEAHLEIREDGTVGGA
ADQSPESLLQLKALKPGVIQILGVKTSRFLCQRPDGALYGSLHFDPEACSFRELLLEDGYNVYQSEAHGLPLH
LGSGRGPARFLPLPGLPPAPPEPPGILAPQPPDVGSSDPLSMVEPSQGRSPSYAS

Compound 149: PKE(1)-L3-FGF21 (Compound 2)                                    (SEQ ID NO: 454)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQEEEEDEEEEDHPIPDSSPLLQFGGQVRQRYLYTDDAQQTEAHLEIREDGT

VGGAADQSPESLLQLKALKPGVIQILGVKTSRFLCQRPDGALYGSLHFDPEACSFRELLLEDGYNVYQSEAHG

LPLHLGSGRGPARFLPLPGLPPAPPEPPGILAPQPPDVGSSDPLSMVEPSQGRSPSYAS

Compound 150: PKE(1)-L4-FGF21 (Compound 2)                                    (SEQ ID NO: 455)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPPTPEPHPIPDSSPLLQFGGQVRQRYLYTDDAQQTEAHLEIREDGTV

GGAADQSPESLLQLKALKPGVIQILGVKTSRFLCQRPDGALYGSLHFDPEACSFRELLLEDGYNVYQSEAHGL

PLHLGSGRGPARFLPLPGLPPAPPEPPGILAPQPPDVGSSDPLSMVEPSQGRSPSYAS

Compound 151: PKE(1)-L5-FGF21 (Compound 2)                                    (SEQ ID NO: 456)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQGSHHHHHHHHGSHPIPDSSPLLQFGGQVRQRYLYTDDAQQTEAHLEIRE

DGTVGGAADQSPESLLQLKALKPGVIQILGVKTSRFLCQRPDGALYGSLHFDPEACSFRELLLEDGYNVYQSE

AHGLPLHLGSGRGPARFLPLPGLPPAPPEPPGILAPQPPDVGSSDPLSMVEPSQGRSPSYAS

Compound 152: PKE(1)-L6-FGF21 (Compound 2)                                    (SEQ ID NO: 457)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQGGGGSGGGGSGGGGSHPIPDSSPLLQFGGQVRQRYLYTDDAQQTEAHLE

IREDGTVGGAADQSPESLLQLKALKPGVIQILGVKTSRFLCQRPDGALYGSLHFDPEACSFRELLLEDGYNVY

QSEAHGLPLHLGSGRGPARFLPLPGLPPAPPEPPGILAPQPPDVGSSDPLSMVEPSQGRSPSYAS

Compound 153: PKE(1)-L7-FGF21 (Compound 2)                                    (SEQ ID NO: 458)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQGGGGGGSGGGSGGGGSHPIPDSSPLLQFGGQVRQRYLYTDDAQQTEAHLE

IREDGTVGGAADQSPESLLQLKALKPGVIQILGVKTSRFLCQRPDGALYGSLHFDPEACSFRELLLEDGYNVY

QSEAHGLPLHLGSGRGPARFLPLPGLPPAPPEPPGILAPQPPDVGSSDPLSMVEPSQGRSPSYAS

Compound 154: PKE(1)-L8-FGF21 (Compound 2)                                    (SEQ ID NO: 459)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQGSGSGSGSGSGSGSGSHPIPDSSPLLQFGGQVRQRYLYTDDAQQTEAHLEI

REDGTVGGAADQSPESLLQLKALKPGVIQILGVKTSRFLCQRPDGALYGSLHFDPEACSFRELLLEDGYNVYQ

SEAHGLPLHLGSGRGPARFLPLPGLPPAPPEPPGILAPQPPDVGSSDPLSMVEPSQGRSPSYAS

Compound 155: PKE(1)-L9-FGF21 (Compound 2)                                    (SEQ ID NO: 460)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSTPPTPSPSTPPTPSPSHPIPDSSPLLQFGGQVRQRYLYTDDAQQTEAHLEI

REDGTVGGAADQSPESLLQLKALKPGVIQILGVKTSRFLCQRPDGALYGSLHFDPEACSFRELLLEDGYNVYQ

SEAHGLPLHLGSGRGPARFLPLPGLPPAPPEPPGILAPQPPDVGSSDPLSMVEPSQGRSPSYAS

Compound 156: PKE(1)-L10-FGF21 (Compound 2)                                   (SEQ ID NO: 461)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQRGGEEKKKEKEKEEQEERETKTPHPIPDSSPLLQFGGQVRQRYLYTDDAQ

QTEAHLEIREDGTVGGAADQSPESLLQLKALKPGVIQILGVKTSRFLCQRPDGALYGSLHFDPEACSFRELLLE

DGYNVYQSEAHGLPLHLGSGRGPARFLPLPGLPPAPPEPPGILAPQPPDVGSSDPLSMVEPSQGRSPSYAS

-continued

Compound 157: PKE(1)-L11-FGF21 (Compound 2) (SEQ ID NO: 462)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQGGGGSGGGGSGGGGSGGGGSGGGGSHPIPDSSPLLQFGGQVRQRYLYTD

DAQQTEAHLEIREDGTVGGAADQSPESLLQLKALKPGVIQILGVKTSRFLCQRPDGALYGSLHFDPEACSFRE

LLLEDGYNVYQSEAHGLPLHLGSGRGPARFLPLPGLPPAPPEPPGILAPQPPDVGSSDPLSMVEPSQGRSPSYA

S

Compound 158: PKE(1)-L12-FGF21 (Compound 2) (SEQ ID NO: 463)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPPTPEPPSPEPPTPEPPSPEPPTPEPHPIPDSSPLLQFGGQVRQRYLYTD

DAQQTEAHLEIREDGTVGGAADQSPESLLQLKALKPGVIQILGVKTSRFLCQRPDGALYGSLHFDPEACSFRE

LLLEDGYNVYQSEAHGLPLHLGSGRGPARFLPLPGLPPAPPEPPGILAPQPPDVGSSDPLSMVEPSQGRSPSYA

S

Compound 159: PKE(1)-L13-FGF21 (Compound 2) (SEQ ID NO: 464)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSTPPTPSPSTPPTPSPSPSTPPTPSPSTPPTPSPSHPIPDSSPLLQFGGQVRQR

YLYTDDAQQTEAHLEIREDGTVGGAADQSPESLLQLKALKPGVIQILGVKTSRFLCQRPDGALYGSLHFDPEA

CSFRELLLEDGYNVYQSEAHGLPLHLGSGRGPARFLPLPGLPPAPPEPPGILAPQPPDVGSSDPLSMVEPSQGR

SPSYAS

Compound 160: PKE(1)-L14-FGF21 (Compound 2) (SEQ ID NO: 465)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPHPIPDSSPLLQFGGQVRQRYLYTDDAQQTEAHLEIREDGTVGGAA

DQSPESLLQLKALKPGVIQILGVKTSRFLCQRPDGALYGSLHFDPEACSFRELLLEDGYNVYQSEAHGLPLHL

GSGRGPARFLPLPGLPPAPPEPPGILAPQPPDVGSSDPLSMVEPSQGRSPSYAS

Compound 161: PKE(1)-L15-FGF21 (Compound 2) (SEQ ID NO: 466)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPPTPEPPSPEPPTPEPHPIPDSSPLLQFGGQVRQRYLYTDDAQQTEAH

LEIREDGTVGGAADQSPESLLQLKALKPGVIQILGVKTSRFLCQRPDGALYGSLHFDPEACSFRELLLEDGYN

VYQSEAHGLPLHLGSGRGPARFLPLPGLPPAPPEPPGILAPQPPDVGSSDPLSMVEPSQGRSPSYAS

Compound 162: PKE(1)-L16-FGF21 (Compound 2) (SEQ ID NO: 467)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPPTPEPPSPEPPTPEPPSPEPPTPEPPSPEPPTPEPHPIPDSSPLLQFGGQ

VRQRYLYTDDAQQTEAHLEIREDGTVGGAADQSPESLLQLKALKPGVIQILGVKTSRFLCQRPDGALYGSLH

FDPEACSFRELLLEDGYNVYQSEAHGLPLHLGSGRGPARFLPLPGLPPAPPEPPGILAPQPPDVGSSDPLSMVEP

SQGRSPSYAS

Compound 163: PKE(1)-L17-FGF21 (Compound 2) (SEQ ID NO: 468)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPTPEPPSPEPPTPEPPSPEPHPIPDSSPLLQFGGQVRQRYLYTDDAQQTEAH

LEIREDGTVGGAADQSPESLLQLKALKPGVIQILGVKTSRFLCQRPDGALYGSLHFDPEACSFRELLLEDGYN

VYQSEAHGLPLHLGSGRGPARFLPLPGLPPAPPEPPGILAPQPPDVGSSDPLSMVEPSQGRSPSYAS

Compound 164: PKE(1)-L18-FGF21 (Compound 2)
(SEQ ID NO: 469)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPGGGSPTPEPHPIPDSSPLLQFGGQVRQRYLYTDDAQQTEAHLEIRE

DGTVGGAADQSPESLLQLKALKPGVIQILGVKTSRFLCQRPDGALYGSLHFDPEACSFRELLLEDGYNVYQSE

AHGLPLHLGSGRGPARFLPLPGLPPAPPEPPGILAPQPPDVGSSDPLSMVEPSQGRSPSYAS

Compound 165: PKE(1)-L19-FGF21 (Compound 2)
(SEQ ID NO: 470)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPEEEDPTPEPHPIPDSSPLLQFGGQVRQRYLYTDDAQQTEAHLEIRE

DGTVGGAADQSPESLLQLKALKPGVIQILGVKTSRFLCQRPDGALYGSLHFDPEACSFRELLLEDGYNVYQSE

AHGLPLHLGSGRGPARFLPLPGLPPAPPEPPGILAPQPPDVGSSDPLSMVEPSQGRSPSYAS

Compound 166: PKE(1)-L20-FGF21 (Compound 2)
(SEQ ID NO: 471)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPPTPEPEEEDPSPEPPTPEPHPIPDSSPLLQFGGQVRQRYLYTDDAQQ

TEAHLEIREDGTVGGAADQSPESLLQLKALKPGVIQILGVKTSRFLCQRPDGALYGSLHFDPEACSFRELLLED

GYNVYQSEAHGLPLHLGSGRGPARFLPLPGLPPAPPEPPGILAPQPPDVGSSDPLSMVEPSQGRSPSYAS

Compound 167: PKE(1)-L21-FGF21 (Compound 2)
(SEQ ID NO: 472)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPTPEPPSPEPPTPEPEEEDPSPEPPTPEPPSPEPHPIPDSSPLLQFGGQVRQRY

LYTDDAQQTEAHLEIREDGTVGGAADQSPESLLQLKALKPGVIQILGVKTSRFLCQRPDGALYGSLHFDPEAC

SFRELLLEDGYNVYQSEAHGLPLHLGSGRGPARFLPLPGLPPAPPEPPGILAPQPPDVGSSDPLSMVEPSQGRSP

SYAS

Compound 168: PKE(1)-L22-FGF21 (Compound 2)
(SEQ ID NO: 473)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPTPEPPSPEPPTPEPGGGSPSPEPPTPEPPSPEPHPIPDSSPLLQFGGQVRQR

YLYTDDAQQTEAHLEIREDGTVGGAADQSPESLLQLKALKPGVIQILGVKTSRFLCQRPDGALYGSLHFDPEA

CSFRELLLEDGYNVYQSEAHGLPLHLGSGRGPARFLPLPGLPPAPPEPPGILAPQPPDVGSSDPLSMVEPSQGR

SPSYAS

Compound 169: PKE(1)-L23-FGF21 (Compound 2)
(SEQ ID NO: 474)

GVSDVPRDLEVVAATPTSLLISWHSYYEQNSYYRITYGETGGNSPVQEFTVPYSQTTATISGLKPGVDYTITVY

AVYGSKYYYPISINYRTEIEKPSQPSPEPTPEPSPEPPTPEPSPEPTPEPHPIPDSSPLLQFGGQVRQRYLYTDDAQ

QTEAHLEIREDGTVGGAADQSPESLLQLKALKPGVIQILGVKTSRFLCQRPDGALYGSLHFDPEACSFRELLLE

DGYNVYQSEAHGLPLHLGSGRGPARFLPLPGLPPAPPEPPGILAPQPPDVGSSDPLSMVEPSQGRSPSYAS

Compound 170 [Fc(hIgG1a_191)-L7-FGF21(Cmp. 2)]
(SEQ ID NO: 475)

DKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVYTLPPSR

DELTKNQVSLTCLVKGFYPSDIAVEWESNGQPENNYKTTPPVLDSDGSFFLYSKLTVDKSRWQQGNVFSCSV

MHEALHNHYTQKSLSLSPGKGGGGSGGGGSGGGGSHPIPDSSPLLQFGGQVRQRYLYTDDAQQTEAHLEIRED

GTVGGAADQSPESLLQLKALKPGVIQILGVKTSRFLCQRPDGALYGSLHFDPEACSFRELLLEDGYNVYQSEAH

GLPLHLGSGRGPARFLPLPGLPPAPPEPPGILAPQPPDVGSSDPLSMVEPSQGRSPSYAS

-continued

Compound 171 [Fc(hIgG1a_191)-L250-FGF21(Cmp. 2)] (SEQ ID NO: 476)

DKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSRWQQGNVFSCSV
MHEALHNHYTQKSLSLSPGKGGGGSGGGGSGGGGSGGGSGGGGSGGGSHPIPDSSPLLQFGGQVRQRYLYTD
DAQQTEAHLEIREDGTVGGAADQSPESLLQLKALKPGVIQILGVKTSRFLCQRPDGALYGSLHFDPEACSFREL
LLEDGYNVYQSEAHGLPLHLGSRGPARFLPLPGLPPAPPEPPGILAPQPPDVGSSDPLSMVEPSQGRSPSYAS

Compound 172 [Fc(hIgG1a_191)-L12-FGF21(Cmp. 2)] (SEQ ID NO: 477)

DKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSRWQQGNVFSCSV
MHEALHNHYTQKSLSLSPGKPSPEPPTPEPPSPEPPTPEPPSPEPPTPEPHPIPDSSPLLQFGGQVRQRYLYTDDAQ
QTEAHLEIREDGTVGGAADQSPESLLQLKALKPGVIQILGVKTSRFLCQRPDGALYGSLHFDPEACSFRELLLED
GYNVYQSEAHGLPLHLGSRGPARFLPLPGLPPAPPEPPGILAPQPPDVGSSDPLSMVEPSQGRSPSYAS

Compound 173 [Fc(hIgG1a_191)-L251-FGF21(Cmp. 2)] (SEQ ID NO: 478)

DKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSRWQQGNVFSCSV
MHEALHNHYTQKSLSLSPGKPSPEPPTPEPPSPEPHPIPDSSPLLQFGGQVRQRYLYTDDAQQTEAHLEIREDGT
VGGAADQSPESLLQLKALKPGVIQILGVKTSRFLCQRPDGALYGSLHFDPEACSFRELLLEDGYNVYQSEAHGL
PLHLGSRGPARFLPLPGLPPAPPEPPGILAPQPPDVGSSDPLSMVEPSQGRSPSYAS

Compound 174 [Fc(hIgG1a_191)-L5-FGF21(Cmp. 2)] (SEQ ID NO: 479)

DKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSRWQQGNVFSCSV
MHEALHNHYTQKSLSLSPGKGSHHHHHHHHGSHPIPDSSPLLQFGGQVRQRYLYTDDAQQTEAHLEIREDGT
VGGAADQSPESLLQLKALKPGVIQILGVKTSRFLCQRPDGALYGSLHFDPEACSFRELLLEDGYNVYQSEAHGL
PLHLGSRGPARFLPLPGLPPAPPEPPGILAPQPPDVGSSDPLSMVEPSQGRSPSYAS

Compound 175 [Fc(hIgG1a_191)-L252-FGF21(Cmp. 2)] (SEQ ID NO: 480)

DKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSRWQQGNVFSCSV
MHEALHNHYTQKSLSLSPGKELQLEESAAEAQEGELEHPIPDSSPLLQFGGQVRQRYLYTDDAQQTEAHLEIRE
DGTVGGAADQSPESLLQLKALKPGVIQILGVKTSRFLCQRPDGALYGSLHFDPEACSFRELLLEDGYNVYQSEA
HGLPLHLGSRGPARFLPLPGLPPAPPEPPGILAPQPPDVGSSDPLSMVEPSQGRSPSYAS

Compound 176 [Fc(hIgG1a_190)-L253-FGF21(Cmp. 2)] (SEQ ID NO: 481)

DKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVYTLPPSR
DELTKNQVSLTCLVKGFYPSDIAVEWESNGQPENNYKTTPPVLDSDGSFFLYSKLTVDKSRWQQGNVFSCSV
MHEALHNHYTQKSLSLSPGSSGGGGSGGGGSGGGGSHPIPDSSPLLQFGGQVRQRYLYTDDAQQTEAHLEIRE

-continued

DGTVGGAADQSPESLLQLKALKPGVIQILGVKTSRFLCQRPDGALYGSLHFDPEACSFRELLLEDGYNVYQSEA

HGLPLHLGSGRGPARFLPLPGLPPAPPEPPGILAPQPPDVGSSDPLSMVEPSQGRSPSYAS

Compound 177 [Fc(hIgG1a_191)-L6-FGF21(Cmp. 2)]
(SEQ ID NO: 482)

DKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVYTLPPSR

DELTKNQVSLTCLVKGFYPSDIAVEWESNGQPENNYKTTPPVLDSDGSFFLYSKLTVDKSRWQQGNVFSCSV

MHEALHNHYTQKSLSLSPGKGGGGSGGGGSGGGGSHPIPDSSPLLQFGGQVRQRYLYTDDAQQTEAHLEIRED

GTVGGAADQSPESLLQLKALKPGVIQILGVKTSRFLCQRPDGALYGSLHFDPEACSFRELLLEDGYNVYQSEAH

GLPLHLGSGRGPARFLPLPGLPPAPPEPPGILAPQPPDVGSSDPLSMVEPSQGRSPSYAS

Compound 178 [Fc(hIgG1a_189)-L6-FGF21(Cmp. 2)]
(SEQ ID NO: 483)

DKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVYTLPPSR

DELTKNQVSLTCLVKGFYPSDIAVEWESNGQPENNYKTTPPVLDSDGSFFLYSKLTVDKSRWQQGNVFSCSV

MHEALHNHYTQKSLSLSPGGGGSGGGGSGGGSHPIPDSSPLLQFGGQVRQRYLYTDDAQQTEAHLEIREDGTV

GGAADQSPESLLQLKALKPGVIQILGVKTSRFLCQRPDGALYGSLHFDPEACSFRELLLEDGYNVYQSEAHGLP

LHLGSGRGPARFLPLPGLPPAPPEPPGILAPQPPDVGSSDPLSMVEPSQGRSPSYAS

Compound 179 [Fc(hIgG1a_191)-L7-FGF21-1 aa(Cmp. 2 with the C-terminal amino acid deleted)]
(SEQ ID NO: 484)

DKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVYTLPPSR

DELTKNQVSLTCLVKGFYPSDIAVEWESNGQPENNYKTTPPVLDSDGSFFLYSKLTVDKSRWQQGNVFSCSV

MHEALHNHYTQKSLSLSPGKGGGGSGGGSGGGGSHPIPDSSPLLQFGGQVRQRYLYTDDAQQTEAHLEIRED

GTVGGAADQSPESLLQLKALKPGVIQILGVKTSRFLCQRPDGALYGSLHFDPEACSFRELLLEDGYNVYQSEAH

GLPLHLGSGRGPARFLPLPGLPPAPPEPPGILAPQPPDVGSSDPLSMVEPSQGRSPSYA

Compound 180 [Fc(hIgG1a_191)-L7-FGF21-3 aa(Cmp. 2 with the three C-terminal amino acids deleted)]
(SEQ ID NO: 485)

DKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVYTLPPSR

DELTKNQVSLTCLVKGFYPSDIAVEWESNGQPENNYKTTPPVLDSDGSFFLYSKLTVDKSRWQQGNVFSCSV

MHEALHNHYTQKSLSLSPGKGGGGSGGGSGGGGSHPIPDSSPLLQFGGQVRQRYLYTDDAQQTEAHLEIRED

GTVGGAADQSPESLLQLKALKPGVIQILGVKTSRFLCQRPDGALYGSLHFDPEACSFRELLLEDGYNVYQSEAH

GLPLHLGSGRGPARFLPLPGLPPAPPEPPGILAPQPPDVGSSDPLSMVEPSQGRSPS

Compound 181 [Fc(hIgG1f_1.1_186)-L7-FGF21 (Cmp. 2)]
(SEQ ID NO: 486)

EPKSSDKTHTCPPCPAPEAEGAPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPSSIEKTISKAKGQPREPQVYT

LPPSREEMTKNQVSLTCLVKGFYPSDIAVEWESNGQPENNYKTTPPVLDSDGSFFLYSKLTVDKSRWQQGNVF

SCSVMHEALHNHYTQKSLSLSPGKGGGGSGGGSGGGGSHPIPDSSPLLQFGGQVRQRYLYTDDAQQTEAHL

EIREDGTVGGAADQSPESLLQLKALKPGVIQILGVKTSRFLCQRPDGALYGSLHFDPEACSFRELLLEDGYNVY

QSEAHGLPLHLGSGRGPARFLPLPGLPPAPPEPPGILAPQPPDVGSSDPLSMVEPSQGRSPSYAS

Compound 182 [Fc(hIgG1a_191b)-L7-FGF21(Cmp. 2)]
(SEQ ID NO: 487)

DKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVYTLPPSR

-continued

```
DEMTKNQVSLTCLVKGFYPSDIAVEWESNGQPENNYKTTPPVLDSDGSFFLYSKLTVDKSRWQQGNVFSCSV

MHEALHNHYTQKSLSLSPGKGGGGSGGGSGGGGSHPIPDSSPLLQFGGQVRQRYLYTDDAQQTEAHLEIRED

GTVGGAADQSPESLLQLKALKPGVIQILGVKTSRFLCQRPDGALYGSLHFDPEACSFRELLLEDGYNVYQSEAH

GLPLHLGSGRGPARFLPLPGLPPAPPEPPGILAPQPPDVGSSDPLSMVEPSQGRSPSYAS
```

Example 5

In Vitro Potency of FGF-21 Deletion Molecules

In this example, the potency of several modified FGF-21 polypeptides is tested and compared to the potency of Pegylated Compound 1 in a cell-based in vitro receptor activation assay. It is shown that several modified FGF-21 polypeptides, including Pegylated Compound 2 have comparable potency to Pegylated Compound 1.

Methods

A clonal human embryonic kidney (HEK) 293 cell line stably expressing human β-klotho was generated to characterize FGF21 variants in the primary in vitro assay. HEK-293 cells were transfected by following the manufacturer's protocol for the LIPOFECTAMINE® 2000 (lipid-based transfection reagent) (INVITROGEN™) transfection reagent and using a linearized plasmid encoding human β-klotho with a C-terminal FLAG tag (N-DYKDDDDK-C (SEQ ID NO:491)in one letter amino acid code) under the control of a cytomegalovirus promoter. Positive clones were isolated after 14 days of growth in selection medium [600 μg/mL of GENETICIN® (2R, 3S, 4R, 5R, 6S)-5-Amino-6-[(1R, 2S, 3S,4R, 6S)-4, 6-diamino-3-[(2R, 3R, 4R, 5R)-3, 5-dihydroxy-5-methyl-4-methylaminooxan-2-yl]oxy-2-hydroxycyclohexyl]oxy-2-(1-hydroxyethyl)oxane-3, 4-diol (INVITROGEN™)) in Dulbecco's modified Eagle's medium (DMEM) with 4.5 g/l D-glucose containing L-Glutamine, Hepes (INVITROGENT™) and 10% fetal bovine serum (FBS)].

The primary assay measured FGF21 variant-dependent phosphorylation of extracellular signal-regulated kinase 1/2 (pERK1/2) in a clonal HEK-293 cell line stably expressing human β-klotho. For assays, the cells were seeded into 96-well tissue culture plates (Falcon) at 40,000 cells per well in 200 μL of selection medium and maintained at 37° C. in a humidified 5% $CO_2$ atmosphere. After 48 hours, the full selection medium was replaced with serum-free medium (DMEM with 4.5 g/l D-glucose and 0.1% fatty acid free bovine serum albumin), and the cells were maintained for 6 hours at 37° C. in a humidified 5% $CO_2$ atmosphere. The compounds to be tested were serially diluted in serum-free medium. The assay was initiated by replacing the serum-free medium on the cells with the diluted compounds, the incubation was allowed to proceed for 7 minutes at room temperature, and the reaction was terminated by removing the compounds and adding 100 μL of lysis buffer (Perkin Elmer AlphaScreen kit) to each well. The plates were shaken at ~80 rpm for approximately 10 minutes at room temperature and stored frozen at −80° C. An aliquot (4 μl) from each well of the thawed cell lysate was analyzed for pERK1/2 according to the manufacturer's protocol for the Surefire AlphaScreen pERK1/2 kit and the AlphaScreen IgG Detection kit, protein A, (Perkin Elmer) using 384 well white Proxiplates (Perkin Elmer). Plates were incubated at room temperature for two hours in the dark and then read on an Envision 2103 Multiplate reader (Perkin Elmer) using the AlphaScreen protocol. Data were fit to a 4 parameter log (agonist) vs. response equation by non-linear regression using GraphPad Prism 5 software.

Results

In vitro potency was determined by measuring FGF21-dependent phosphorylation of extracellular signal-regulated kinase (ERK) 1/2 in a human embryonic kidney (HEK) 293 cell line in which human 13-Klotho has been stably introduced to function as a co-receptor with endogenously expressed FGFR splice variants. Potency was evaluated by determining the mean $EC_{50}$ or $pEC_{50}$ (negative base 10 log of the $EC_{50}$ concentration expressed in moles per liter) value for each tested compound. An exemplary dose-response curve is shown in FIG. 2 for Pegylated Compound 1 and Pegylated Compound 2. Results for additional tested compounds are shown in Tables 4 and 5.

TABLE 4

EC50 values for in vitro modified FGF-21 activity in the pERK assay.

| Compound Name | pERK EC50 (nM) n = 3 |
| --- | --- |
| Pegylated Compound 1 | 6.7 |
| Compound 2 | 4.6 |
| Compound 3 | 28 |
| Compound 5 | 69.2 |
| Compound 6 | 39.1 |
| Compound 7 | 28.4 |
| Compound 10 | 21.9 |
| Compound 11 | 28.2 |
| Compound 12 | 31.9 |
| Compound 19 | 5.1 |
| Compound 20 | 3.9 |
| Compound 22 | 4.1 |
| Compound 23 | 30 |

TABLE 5

EC50 values for in vitro modified FGF-21 activity in the pERK assay.

| Compound Name | EC50 (nM) |
| --- | --- |
| Pegylated Compound 1 | 14 |
| Pegylated Compound 2 | 28 |
| Pegylated Compound 5 | 24 |
| Pegylated Compound 6 | 20 |
| Pegylated Compound 10 | 28 |
| Pegylated Compound 11 | 30 |
| Pegylated Compound 12 | 39 |
| Pegylated Compound 19 | 30 |
| Pegylated Compound 20 | 42 |
| Pegylated Compound 21 | 30 |
| Pegylated Compound 22 | 36 |
| Compound 32 (Non-Pegylated Control) | 8 |

Example 6

Thermal Stability Testing of Modified FGF-21 Polypeptides

In this example, thermal stability of modified FGF-21 polypeptides was measured using Thermal Scanning Fluorescence (TSF) and Differential Scanning calorimetry (DSC). Thermal stability is recognized in the literature to have predictive value for determining propensity to form aggregates (see, e.g., Webster, "Predicting Long-Term Storage Stability of Therapeutic Proteins," Pharmaceutical Technology, Volume 37, Issue 11, pp. 42-48, Nov. 2, 2013).

Methods

Thermal midpoints of denaturation were measured by differential scanning calorimetry in a MicroCal (Malvern Instruments) auto VP-DSC. For DSC analysis, the protein samples were formulated in 250 mM sucrose, 20 mm histidine pH 7.0 at approximately 2 mg/mL with a scan rate of 90° C. per hour. The reference cell was filled with the identical buffer sans protein. The transition midpoints (Tm) of the phase change between folded and thermally unfolded protein domains under the solution conditions and scan rate applied was determined from the peak maximums seen in the thermogram trace (arrows).

For thermal scanning fluorescence (TSF), protein is diluted to 0.2 mg/mL into the buffer of interest and a small amount of fluorescent fluorophore anilinonaphthalene sulfonic acid (ANS) is added. Samples are placed in a 96 well PCR thin wall plate and the temperature of the protein sample in the presence of the extrinsic fluorophore is increased while the fluorescence of the sample is monitored on a Bio-Rad CT1000-RT PCR instrument. The midpoint of protein thermal unfolding of the protein is determined by monitoring the increase in fluorescent signal of the probe as it interacts with the newly exposed hydrophobic core of thermally denaturing protein. The temperature at the midpoint of unfolding (Tm) under the buffer and scan rate conditions examined was defined as the temperature inflection point of the fluorescent signal rise curve.

Results

Figure 3:
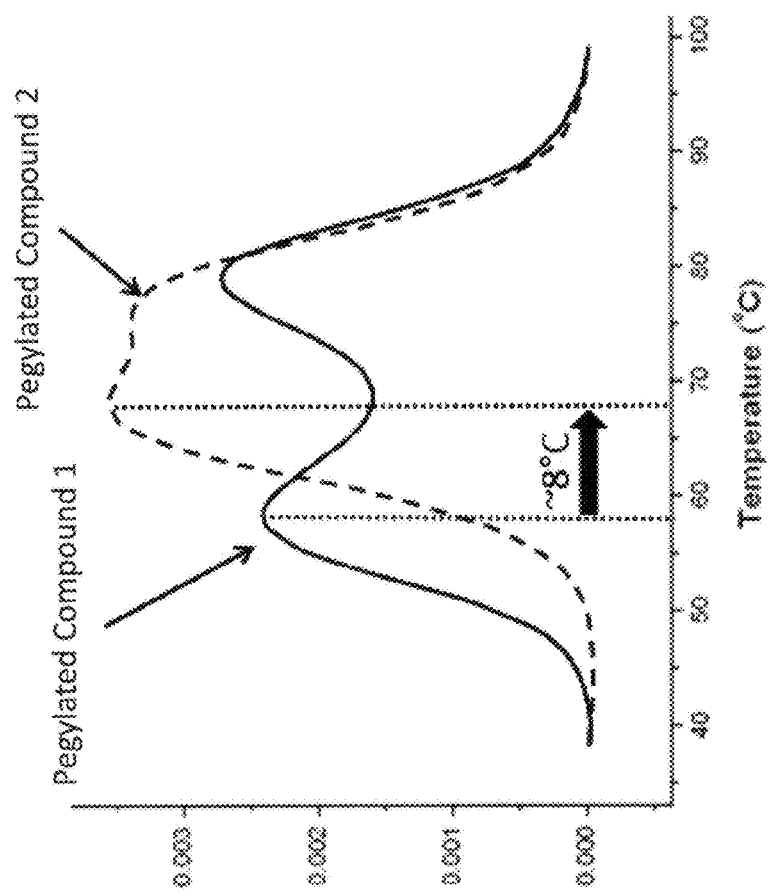
FIG. 3. Representative results of differential scanning calorimetry (DSC) performed for evaluation of thermal stability of modified FGF-21 polypeptides. In this example, Pegylated Compound 2 was shown to have a transition midpoint ("Tm") temperature approximately 8 degrees C. higher than Pegylated Compound 1. Thermal reversibility was >95% (not shown).

Representative DSC scanning results are shown in FIG. 3. Pegylated Compound 2 was observed to have a transition midpoint ("Tm") temperature approximately 8 degrees C. higher than Pegylated Compound 1. Thermal reversibility was >95% (data not shown).

Figure 4:
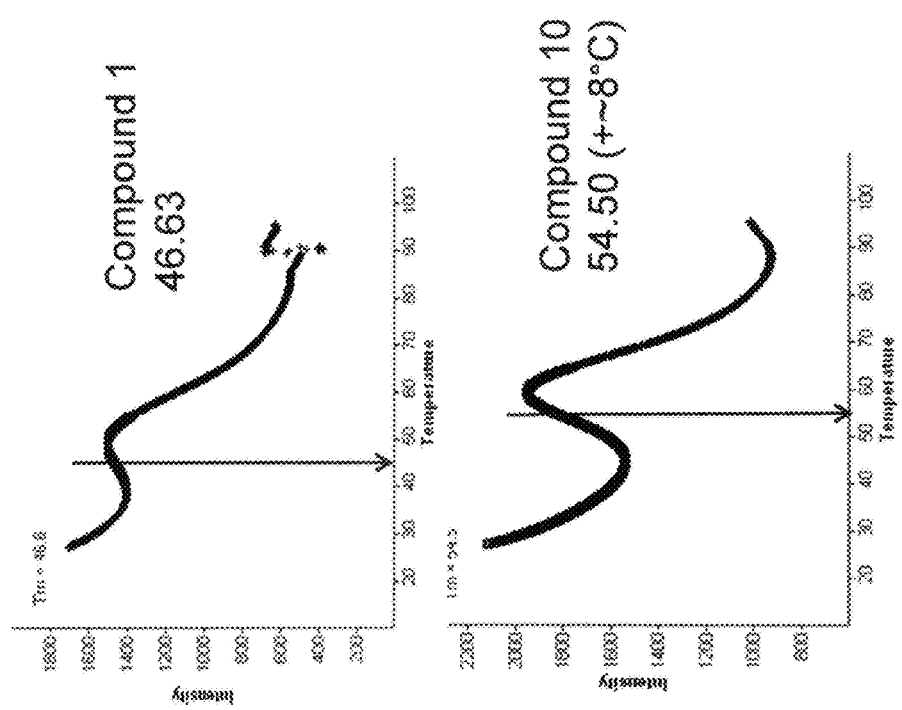
FIG. 4. Representative results of thermal scanning fluorescence (TSF) performed for evaluation of thermal stability of modified FGF-21 polypeptides. In this figure, Compound 10 was shown to have a transition midpoint ("Tm") temperature approximately 8 degrees C. higher than Compound 1 (having a wild-type FGF-21 sequence except that an N-terminal methionine included for expression in $E.\ coli$).

FIG. 4 shows representative results for TSF. Compound 10 exhibited an approximately 8 degrees C. increase in Tm relative to Compound 1 (having a wild-type FGF-21 sequence except that an N-terminal methionine included for expression in *E. coli*). Results for additional compounds are shown in Table 6, below.

Together these results indicate that exemplary compounds would be reasonably expected to have a decreased propensity to form aggregates, for example, Compounds 2, 10, and 16. The decreased propensity to form aggregates is expected to confer a longer shelf-life and/or the ability to be formulated to a greater concentration.

TABLE 6

Thermal stability results determined by thermal scanning fluorescence for modified FGF-21 polypeptides compared to Compound 1. Increased thermal stability was observed up to approximately 7-8 degrees C. for some compounds.

| Compound | Tm (degrees C.) | Difference from Compound 1 |
|---|---|---|
| Compound 1 | 46.63 | 0 |
| Compound 2 | 53.2 | 6.57 |
| Compound 3 | 46.92 | 0.29 |
| Compound 5 | 47.46 | 0.83 |
| Compound 6 | 43.2 | -3.43 |
| Compound 7 | 42.78 | -3.85 |
| Compound 10 | 54.5 | 7.87 |
| Compound 11 | 43.9 | -2.73 |
| Compound 12 | 45.4 | -1.23 |
| Compound 14 | 42.97 | -3.66 |
| Compound 16 | 50.8 | 4.17 |
| Compound 18 | 47.96 | 1.33 |

Example 7

Deamidation and Aggregate Formation

This example describes assessment of deamidation and aggregate formation for of modified FGF-21 polypeptides.

Methods

Thermal Stress Tests:

Protein samples of interest are prepared in the test buffer (250 mM sucrose, 20 mM Histidine, pH 6.5, and pH 7 or 20 mM TRIS pH 7.5) at a concentration of 7.5 mg protein/mL. Samples were examined by analytical size exclusion chromatography (aSEC) and charge variant analysis by imaged capillary isoelectric focusing (icIEF) at time=0. Samples were then stress tested by placing them in an incubator 25° C. for 1 week and then at 40° C. for 5 weeks. Aliquots were withdrawn and examined by icIEF and aSEC at various time pointS over the next 4 to 5 weeks were withdrawn and further examined by aSEC and icIEF to monitor stability.

aSEC

The size exclusion chromatography (aSEC) was conducted using Agilent 1100 HPLC system (Agilent Technologies, Santa Clara, Calif. USA) on a Zenix-C 300 SEC column (Sepax Technologies, Newark, Del. USA) with a dimension of 300×4.6 mm. The mobile phase used was 200 mM potassium phosphate and 150 mM sodium chloride adjusted to pH 6.9, at a flow rate of 0.35 mL/min. Approximately 20 µg sample was injected for each analysis. The separation was monitored at UV 280 nm Quantification of monomer vs HMW species was performed by integration of the area under the curve at retention times corresponding to each species.

icIEF

Deamidation was detected by charge variant analysis (deamidation increases the net negative charge of the protein and the formation of acidic variants) conducted by imaged capillary isoelectric focusing (icIEF), which was performed on an iCE280 instrument (ProteinSimple, Santa Clara, Calif. USA) using a fluorocarbon coated capillary, 100 µm×50 mm. The sample was diluted to 0.3 mg/mL using a solution that contains 0.35% methyl cellulose, 4% pH3-10 Pharmalytes, 4M urea, and 2% pI marker. The anolyte and catholyte are 0.08 M phosphoric acid and 0.1 M sodium hydroxide, respectively. The focusing was achieved by applying 1.5 kV for 2 min and then 3.0 kV for 11 min. Quantification of (−) charge modified species relative to the parent species was performed by integration of the corresponding area under the curves.

Results

Figure 5:
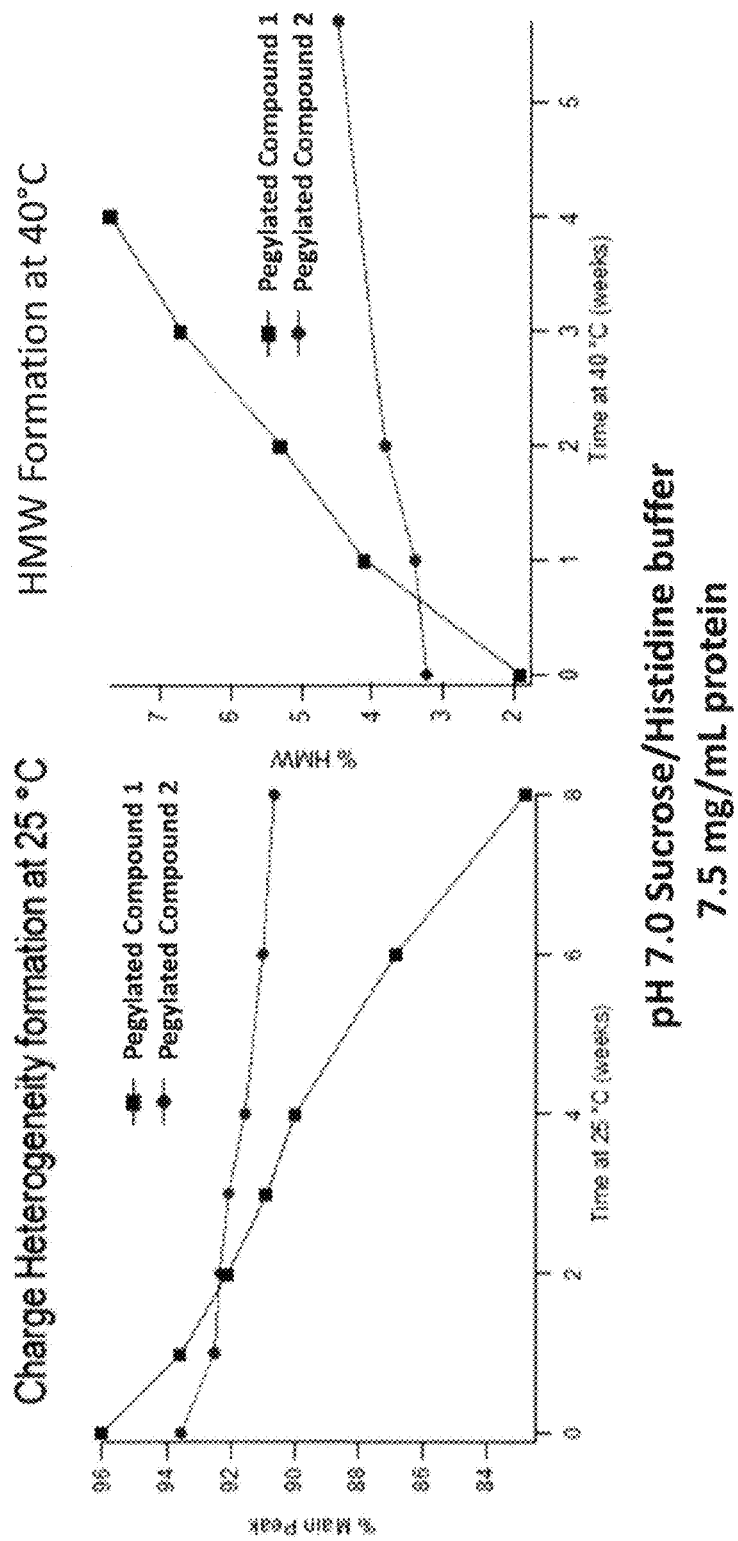
FIG. 5. Left Panel: Measurement of deamidation over time (indicated by charge heterogeneity) at 25 degrees C. for Pegylated Compound 1 and Pegylated Compound 2. Pegylated Compound 2 exhibited decreased charge heterogeneity formation, indicative of greatly slowed deamidation. Right Panel: Measurement of aggregate formation over time (measured by size exclusion chromatography) at 40 degrees C. for Pegylated Compound 1 and Pegylated Compound 2 each in Sucrose/Histidine buffer at pH 7.0 and a protein concentration of 7.5 mg/mL. Pegylated Compound 2 exhibited decreased aggregate formation. Together, these results are predictive of greater shelf stability and ability to be formulated to a higher concentration for Pegylated Compound 2 relative to Pegylated Compound 1.

The biophysical properties of Pegylated Compound 2 demonstrated superiority over Pegylated Compound 1. No degradation was observed through 5 weeks at 2-8° C. coupled with low rates of degradation observed under accelerated in conditions at 40° C. relative to Pegylated Compound 1 (FIG. 5). Eight week accelerated studies indicate that Pegylated Compound 2 is superior to Pegylated Compound 1 in the tested formulation (Histidine/Sucrose pH7.0). Under these excipient conditions, deamidation is abrogated and Pegylated Compound 2 has a decreased propensity to form soluble high molecular weight (HMW) aggregates. These results suggest Pegylated Compound 2 has a broader pH window for formulation options with lessened aggregation propensities relative to Pegylated Compound 1.

Figure 6:
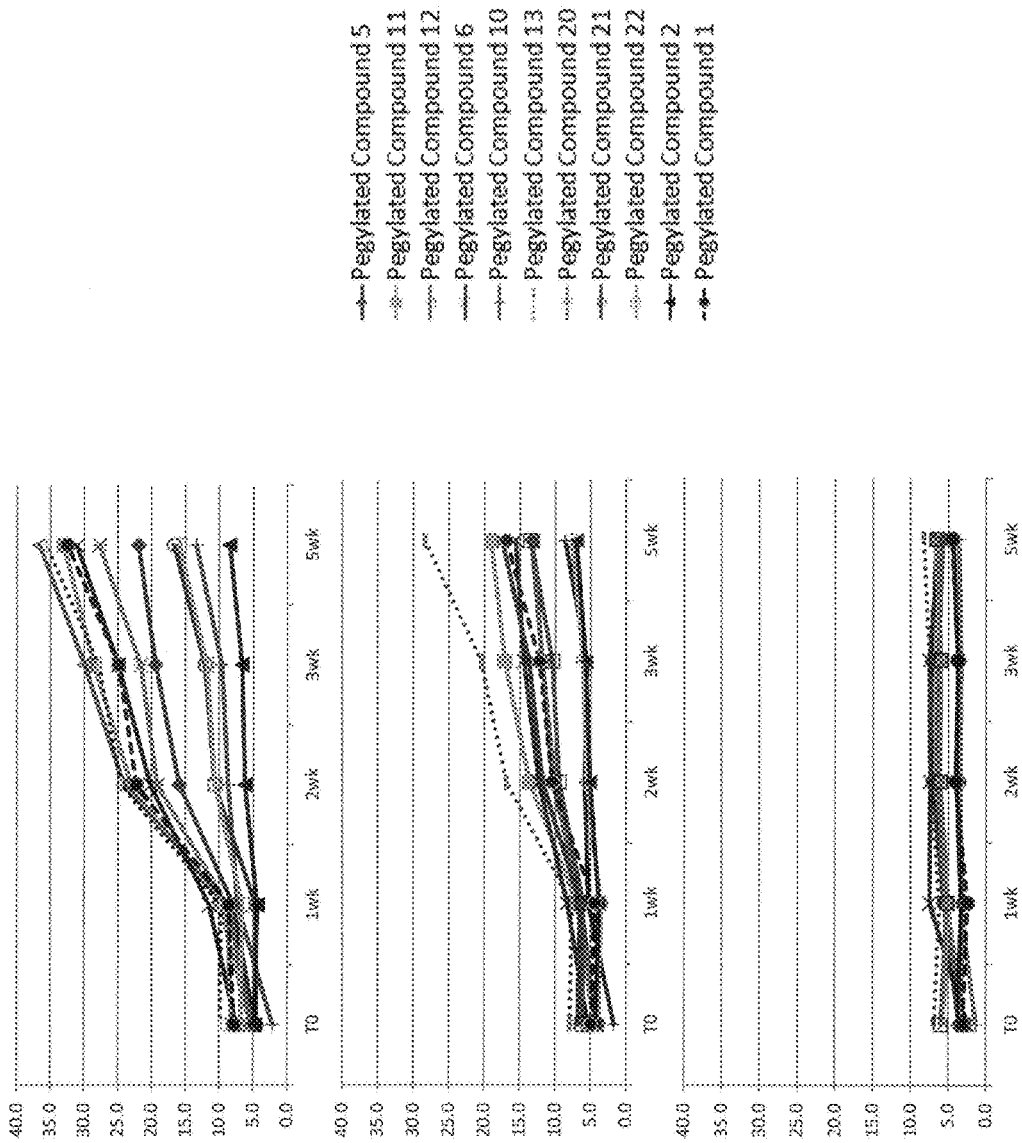
FIG. 6. Measurement of high molecular weight (HMW) aggregate formation over time for modified FGF-21 polypeptides at pH 6.5 in sucrose/histidine buffer (upper panel), pH 7.0 in sucrose/histidine buffer (middle panel), and pH 8.3 in sucrose/TRIS buffer (lower panel). HMW aggregate formation was more pronounced at pH 6.5 and pH 7.0 than at pH 8.3. The majority of FGF-21 variants exhibited decreased HMW aggregate formation relative to Pegylated Compound 1, though for a few compounds HMW aggregate formation was similar to or higher than for Compound 1, FIG. 7. Measurement of deamidation propensity (indicated by formation of acidic variants over time) for modified FGF-21 polypeptides at pH 6.5 in sucrose/histidine buffer (upper panel), pH 7.0 in sucrose/histidine buffer (middle panel), and pH 8.3 in sucrose/TRIS buffer (lower panel). Compared to Pegylated Compound 1, all compounds shown exhibited decreased charge acidic variant formation, indicating decreased deamidation.

HMW aggregate formation was also assessed. Lower HMW aggregate formation at a given concentration is indicative of greater solubility, which would result in the ability to be formulated to a higher concentration. FIG. 6 illustrates HMW aggregate formation for several modified FGF-21 polypeptides and Compound 1. For the majority of tested compounds, aggregate formation was decreased relative to Pegylated Compound 1 (e.g. Pegylated Compound 2 and Pegylated Compound 10). For a few compounds, HMW aggregate formation was similar to or higher than for Pegylated Compound 1.

Figure 7:
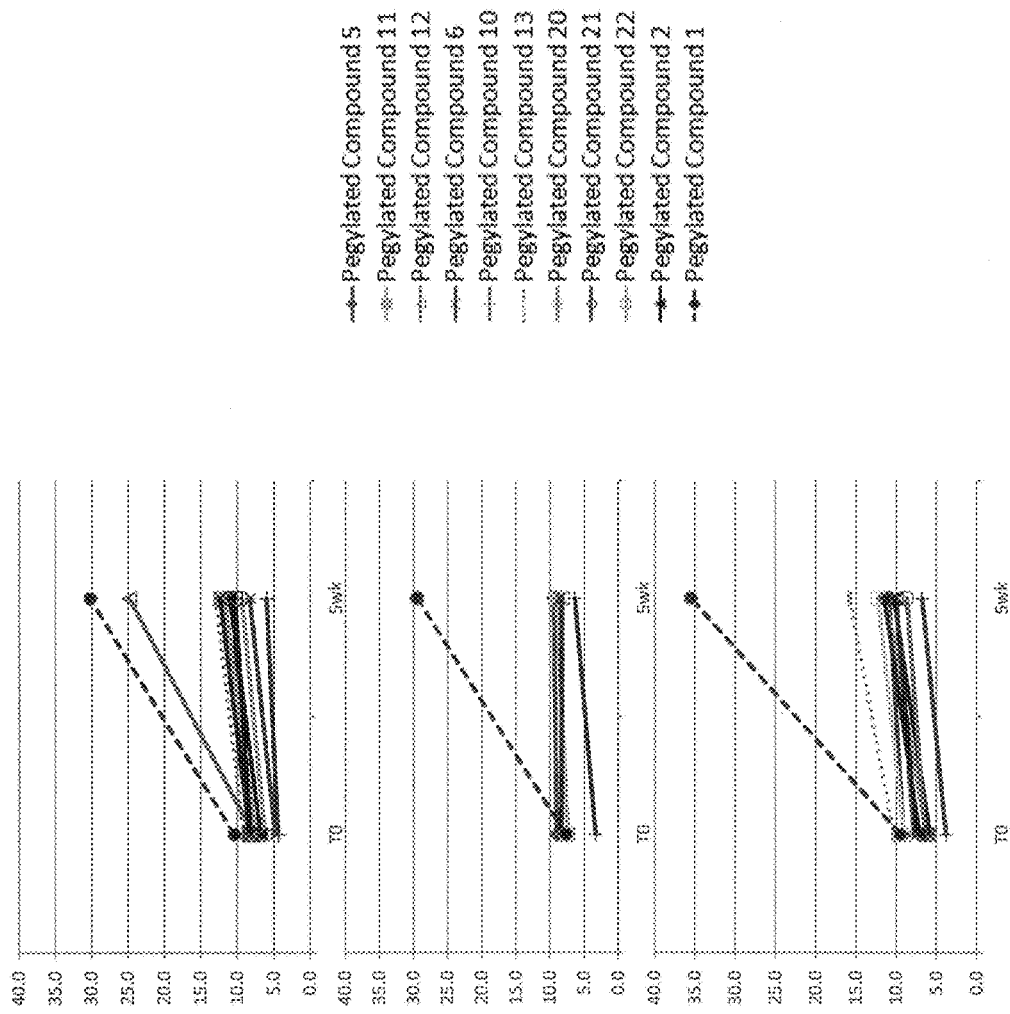

Deamidation was also assessed. FIG. 7 illustrates the detected levels of deamidation (indicated by formation of acidic variants over time) for several modified FGF-21 polypeptides and Pegylated Compound 1. For all modified FGF-21 polypeptides shown, the level of deamidation detected was decreased relative to Pegylated Compound 1.

Example 8

Solubility Assessment of Modified FGF-21 Polypeptides

This example describes measurement of the relative solubility of modified FGF-21 polypeptides. The results are indicative of the ability of a compound to be formulated to a relatively higher concentration, which would permit more facile administration of an effective dosage.

Methods

Relative solubility assessments were performed by sequential plug-flow concentration cycles followed by size-exclusion chromatography analysis. Samples, formulated in PBS pH 7.2 at similar but not identical starting concentrations, were pipetted into 3 kDa molecular weight cut-off centrifuge concentrators and spun at 4,750 RPM for 10 minute, 15 minute, and 30 minute cycles at 4° C. In between spin cycles, aliquots were removed from the concentration apparatus and analytical size exclusion chromatography analysis (aSEC) was performed (on a GE Healthcare Superdex S-75 10/300 GL column equilibrated in PBS pH 7.2 buffer) to determine the concentration of HMW and monomer species in the solution.

Total Concentrations were determined by absorbance at 280 nm with a NanoDrop spectrophotometer. High molecular weight percentage was determined by area under the curve calculations of high molecular weight peaks relative to the monomer peaks in the SEC chromatogram trace. The resulting data points are plotted to visualize the rank order of least soluble constructs to most soluble under the conditions tested, the lower the slope created by the data points the more stable the protein variant under the conditions tested Results Relative solubility of Modified FGF-21 polypeptides was determined by measuring the formation of high molecular weight (HMW) aggregates as a function of protein concentration. Lower HMW aggregate formation at a given concentration is indicative of greater solubility, which would result in the ability to be formulated to a higher concentration.

Figure 8:
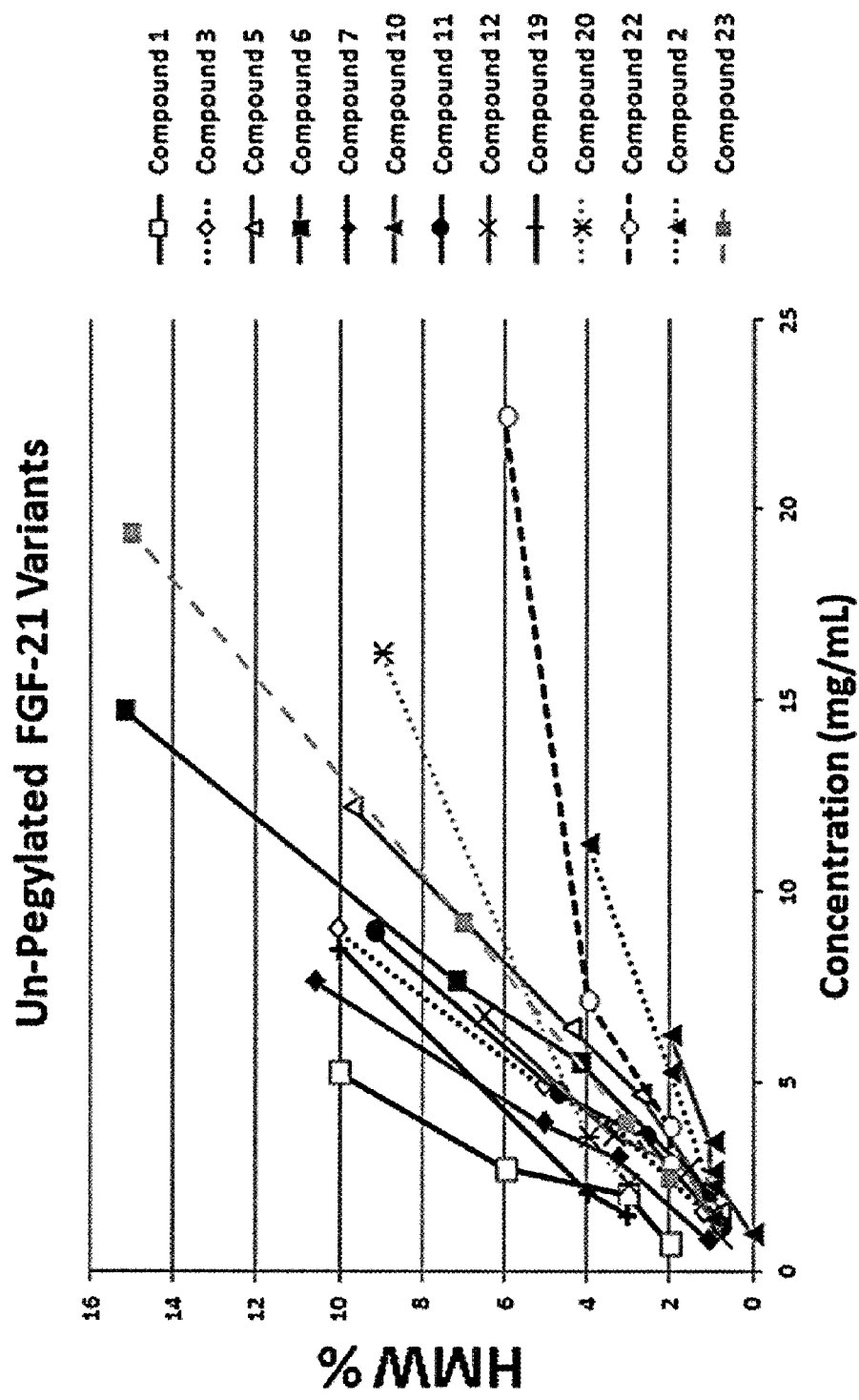
FIG. 8. Measurement of solubility for modified FGF-21 polypeptides. Relatively lower formation of high molecular weight aggregates at a given polypeptide concentration is indicative of greater solubility, which would result in the ability to be formulated to a greater concentration. Observations of protein concentration vs. percent fraction of High Molecular Weight (HMW) species of tested compounds determined via the plug flow filtration assay in PBS buffer at pH 7.2. The linearized slope of the line fit to each of these observations was used as an estimate of protein aggregation propensity.

The slope of the plug flow solubility curve for the tested compounds is shown below in Table 7 (lower values indicate less aggregate formation and hence the ability to be formulated to a higher concentration). Relatively low aggregate formation levels were observed for several of the compounds (e.g. Compound 2 and Compound 10), indicating lower aggregate formation and greater solubility (FIG. 8 and Table 7). The highest plug flow solubility slope was observed for Compound 1.

TABLE 7

Plug Flow Solubility Results for modified FGF-21 Polypeptides.

| Compound | Plug Flow Solubility Slope |
|---|---|
| Compound 1 | 1.863 |
| Compound 2 | 0.3171 |
| Compound 3 | 1.2219 |
| Compound 5 | 0.8548 |
| Compound 6 | 1.1353 |
| Compound 7 | 1.4318 |
| Compound 10 | 0.3647 |
| Compound 11 | 1.1156 |
| Compound 12 | 1.0317 |
| Compound 19 | 0.9743 |
| Compound 20 | 1.1545 |
| Compound 22 | 0.1997 |
| Compound 23 | 0.771 |

Example 9

Immunogenicity Testing of FGF-21 Deletion Molecules

T-cell activation response studies were performed, and indicate the protein sequence used in the majority of the compounds presented an equivalent response to the protein sequence used in Pegylated Compound 1.

Methods

Immunogenicity was assessed by a CD4+ T cell proliferation assay. Peripheral blood mononuclear cells (PBMCs) from a diverse set of human blood donors were isolated using a Ficoll gradient. Donors were HLA typed to ensure coverage of the variability in the MHC class II allele present in the human population. After labeling, the PBMCs with Carboxyfluorescein succinimidyl ester (CFSE) were plated in 96 well format at 200,000 cells per well in standard cell culture media in the presence of the tested compound for 7 days. Proliferation of the CD4+ T cells was analyzed by labeling with an anti CD4 antibody and flow cytometry. The percentage antigenicity protein's is calculated as the percentage of donors that show significant CD4+ T cell proliferation response vs a media control.

Results

Figure 9:
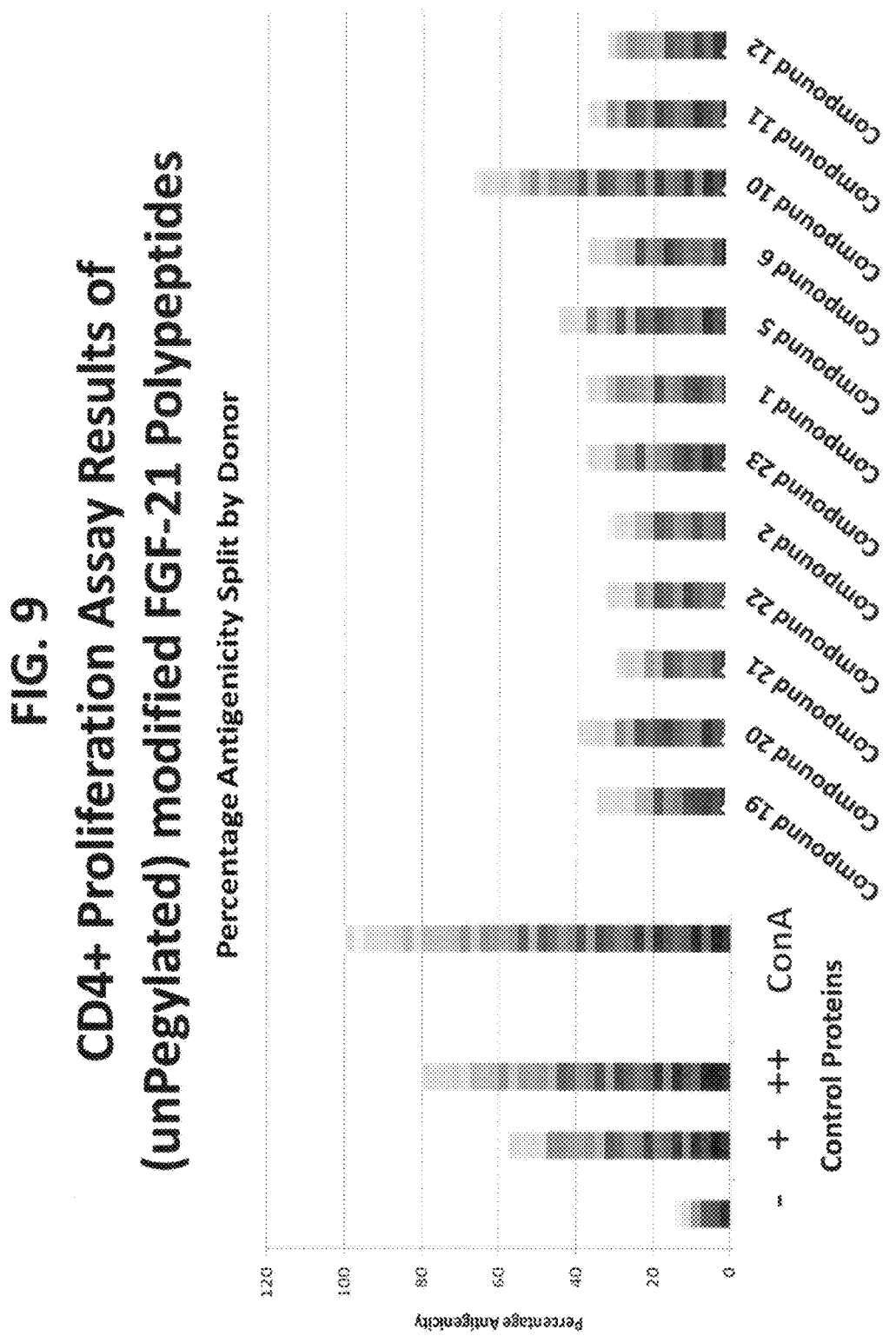
FIG. 9. Percentage of donors with a CD4+ T cell proliferation response following a 7 day protein and peripheral blood mononuclear cell (PBMC) incubation. The control proteins are $E.\ coli$ expressed proteins with known T cell activation properties. Comparison of non-pegylated modified FGF-21 compounds to Compound 1 (having a wild-type FGF-21 sequence except that an N-terminal methionine included for expression in $E.\ coli$). "ConA" is an abbreviation for Concanavalin A, a known immunogenic protein.

In an in vitro immunogenicity risk assessment utilizing a human T cell proliferation assay 13 out of 40 donors (32.5%) showed CD4+ proliferative response after 7 days of exposure to Compound 2 compared to 15 out of 40 donors that showed a positive signal from Compound 1 (having a wild-type FGF-21 sequence except that an N-terminal methionine included for expression in $E.\ coli$) (FIG. 9).

While this cell based experiment does not replace real world human immunologic response observations this analysis suggests that there is no increased human immunogenicity risk for Compound 2 compared to wild type FGF21.

Further modified FGF-21 polypeptides were tested in the CD4+ proliferation assay relative to Compound 1 (FIG. 9) Immunogenicity was generally similar to that observed for the control FGF21 sequence (Compound 1), with the exception of Compound 10 which exhibited a relatively higher immune response, indicating that the compound might be undesirably immunogenic if administered to human patients.

Example 10

In Vivo Stability of C-Terminally Intact (Active) Modified FGF-21 Polypeptides

This study assessed the level of the C-terminally intact (i.e., active) modified FGF-21 polypeptides in vivo. Pegylated Compound 2 exhibited a greatly increased proportion of C-terminally intact, active polypeptide compared with Pegylated Compound 1, including a greater duration of in vivo activity.

Methods

The pharmacokinetics of Pegylated Compound 2 and Pegylated Compound 1 were evaluated in Cynomolgus monkeys following a subcutaneous (SC) dose of 0.25 mg/Kg and 0.225 mg/kg respectively. Blood samples (0.2 mL) were collected at 0, 0.25, 0.5, 1, 3, 7, 24, 48, 72, 96, 120, 144, 168 hr following drug administration and stored at −80° C. until bioanalysis.

The PK parameters of total and C-terminal intact Pegylated Compound 1 and Pegylated Compound 2 were obtained by non-compartmental analysis of serum or plasma concentration vs time data (Phoenix™ WinNonlin®, 6.3, Pharsight Corporation, St. Louis, Mo.). The area under the curve from time zero to infinity [AUC(tot)] were calculated using a combination of linear and log trapezoidal summations. Estimations of AUC and half-life (t ½) were made using a minimum of 3 timepoints with quantifiable concentrations.

Concentrations of total Pegylated Compound 1 in the single-dose PK studies were measured using a non-validated, Meso Scale Discovery (MSD)-based electrochemiluminescent immunosorbent assay (ECLIA). A PEG-specific monoclonal antibody (mAb) was used to capture Pegylated Compound 1, followed by the use of a rabbit anti-FGF21 polyclonal antibody (pAb) for detection of total Pegylated Compound 1.

The subcutaneous (SC) pharmacokinetics (PK) of Pegylated Compound 2 and Pegylated Compound 1 were also evaluated in male Ob/Ob mice. Pegylated Compound 2 was administered to mice (n=3/timepoint/route) as a single SC 0.1 mg/kg injection. Pegylated Compound 1 was administered as a single SC dose of 0.05 mg/kg. Blood samples were collected at various time points following drug administration and processed essentially as described for the cynomolgus monkeys.

The read-out was via electrochemiluminescence, expressed in relative light units (RLU), which was proportional to the amount of total Pegylated Compound 1 bound by the capture and detection reagents. The standard curves were between 0.2 and 154 ng/mL. Test samples were quantified using a 4-parameter logistic fit regression model with a weighting factor of 1/Y. The same assay was used to measure the concentrations of C-terminal intact Pegylated Compound 1 in ZDF rat and cynomolgus monkey serum except a rabbit anti-FGF21 pAb specific to the C-terminus of Pegylated Compound 1 was used for detection. The standard curves were between 0.2 and 154 ng/mL. Test samples were quantified using a 4-parameter logistic fit regression model with a weighting factor of 1/Y.

Results

Figure 10:
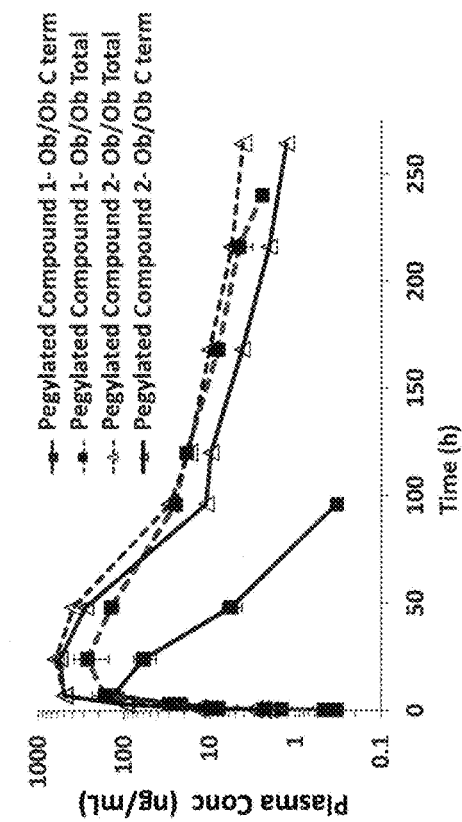
FIG. 10. Pharmacokinetic analysis of Pegylated Compound 1 and Pegylated Compound 2 after a single S.C. administration of 0.05 mg/kg to ob/ob mice. Levels of the modified FGF-21 compounds were measured as both the total and C-terminally intact (active) polypeptides. Pegylated Compound 2 exhibited a much greater total AUC for the C-terminally intact form than Pegylated Compound 1, indicating greatly reduced in vivo proteolysis of Pegylated Compound 2. Results are shown graphically in the upper panel and pharmacokinetic parameters are tabulated in the lower left panel (Pegylated Compound 1) and lower right panel (Pegylated Compound 2).

Pegylated Compound 1 undergoes proteolysis in vivo, such that over time the majority of the compound becomes a truncated, inactive form. The in vivo proteolytic stability of Pegylated Compounds 1 and 2 was compared head-to-head in ob/ob mice (FIG. 10) and cynomolgus monkeys (FIG. 11). These results show that the AUC of the active C-terminal intact form increased by 7- to 8-fold for the modified FGF-21 compound containing the deletion (Pegylated Compound 2) as compared with Pegylated Compound 1, indicating Pegylated Compound 2 has increased in vivo proteolytic stability.

Example 11

Pharmacokinetic Studies of Modified FGF-21 Polypeptides

This example presents the results of pharmacokinetic studies using modified FGF-21 polypeptides in mice, rats, and cynomolgus monkeys (see Table 8, below).

Briefly, the clearance of Pegylated Compound 2 was low in mice, rats, and monkeys (range: 0.94-2.6 mL/h/kg). The volume of distribution (Vss), at ~0.04-0.05 L/kg, was close to plasma volume and indicated minimal distribution into the extravascular space. The subcutaneous (SC) bioavailability was acceptable in mice (40%) and monkeys (58%), while it was relatively low in rats (16%). This low SC bioavailability could be rat-specific, as other PEGylated molecules have been observed to have a similar phenomenon (low SC bioavailability in rats with good bioavailability in mice, monkeys, and humans). More importantly, the SC bioavailability for Pegylated Compound 2 in these species (including the rat) was 2-3.4 fold higher relative to Pegylated Compound 1.

Following SC administration of Pegylated Compound 2 to mice, rats, and monkeys, there was a consistent (7-8 fold) increase in dose normalized exposure (AUC) of intact protein, relative to Pegylated Compound 1. The increased exposures of intact Pegylated Compound 2 after subcutaneous administration can be attributed to lower systemic clearance (2-5 fold) along with an improvement (2-3.4 fold) in subcutaneous bioavailability in all the three species relative to Pegylated Compound 1.

Total Pegylated Compound 2, composed of a mixture of proteolytic fragments and intact Pegylated Compound 2, was also measured in these pharmacokinetic studies. The AUC ratio of intact Pegylated Compound 2 over total Pegylated Compound 2 in mice and rats was close to 1 following IV administration indicating minimal systemic proteolysis. However, following SC administration, the ratio was 0.6-0.86 in these species indicating some proteolysis in the SC site. A similar trend was noted in monkeys wherein the AUC ratio of intact Pegylated Compound 2 over total Pegylated Compound 2 was modestly lower after SC administration compared to IV (0.7 after SC vs. 0.8 after IV dosing).

Overall, Pegylated Compound 2 demonstrated favorable in vitro and in vivo pharmacokinetic properties including increased bioavailability, decreased clearance and increased AUC (area under the plasma concentration-time curve).

TABLE 8

IV & SC Pharmacokinetics of Intact modified FGF-21 Protein in Mouse, Rat, and Monkey.

| | Species | | | | | |
|---|---|---|---|---|---|---|
| | Mouse | | Rat | | Monkey | |
| | Pegylated Compound 1 | Pegylated Compound 2 | Pegylated Compound 1 | Pegylated Compound 2 | Pegylated Compound 1 | Pegylated Compound 2 |
| CL (mL/h/kg) | 6.1 | 2.5 | 6.2 ± 0.7 | 2.6 ± 0.4 | 4.4 ± 1 | 0.94 ± 0.05 |
| Vss (L/kg) | 0.043 | 0.044 | 0.05 ± 0.01 | 0.05 ± 0.01 | 0.07 ± 0.005 | 0.04 ± 0.003 |
| Half Life (h) | 47 | 26 | 35 ± 1 | 24 ± 3.9 | 13 ± 2 | 57 ± 4.2 |
| MRT (h) | 7.1 | 20 | 8.4 ± 0.3 | 20 ± 1.3 | 16 ± 2.5 | 47 ± 1.5 |
| SC BA (%) | 15 | 40 | 4.8 | 16.3 | 30 | 58 |
| SC AUC (µg/mL * h) | 1.2 | 8.1 | 0.39 ± 0.07 | 3.1 ± 0.2 | 20 ± 2.2 | 154 ± 63 |

Abbreviations:
CL: Apparent total body clearance of the drug from plasma;
Vss: Apparent volume of distribution at steady state;
MRT: Mean residence time;
SC BA: subcutaneous bioavailability;
SC AUC: subcutaneous area under the plasma concentration-time curve.

Example 12

Repeated Dosing In Vivo Studies of Modified FGF-21 Polypeptides in a Mouse Model of Diabetes Pegylated Compound 2 and Pegylated Compound 1 were evaluated head-to-head in a 21-day repeated dosing study. The results demonstrate that while both compounds were effective for ameliorating metabolic symptoms, the longer in vivo half-life of the active Pegylated Compound 2 resulted in greater therapeutic effects, particularly when comparing the effects of weekly dosing.

Methods

Male ob/ob mice (Jackson Laboratories, Bar Harbor, Me.) were 8 weeks of age at the start of the study. Mice were randomized into treatment groups based on body weight and glucose levels. All groups were treated by subcutaneous (s.c.) administration of 1 ml/kg dosing solutions. The treatment groups were as follows: 1) vehicle (250 mM sucrose/20 mM Tris, pH 8.3) twice weekly (BIW), 2) Pegylated Compound 1, 0.15 mg/kg BIW, 3) Pegylated Compound 2, 0.15 mg/kg BIW, 4) Pegylated Compound 1, 0.3 mg/kg once weekly (QW), or 5) Pegylated Compound 2, 0.3 mg/kg QW. Mice that were only administered compound once weekly were administered vehicle on the days when BIW groups were administered their second weekly injection of compound. Body weight, plasma glucose, triglycerides (Olympus clinical chemistry analyzer, AU680), and insulin (ELISA, Mercodia Inc.) were determined throughout the 21 day dosing period in the fed state. Glycated hemoglobin (HbA1c) was determined in whole blood at study start and termination, also with the Olympus analyzer.

Results

Both Pegylated Compound 1 and Pegylated Compound 2 were administered subcutaneously using doses of 0.15 mg/kg twice weekly (BIW) and 0.3 mg/kg QW. The plasma concentrations measured at trough on day 21 show that exposure of total (intact and proteolyzed) FGF21 was similar for both variants, but exposure of active, C-terminal intact Pegylated Compound 2 was 12- to 25-fold higher than that of Pegylated Compound 1 following QW or BIW administration, respectively (Table 9).

TABLE 9

Exposure of C-terminal intact Pegylated Compound 1 and Pegylated Compound 2 at trough after 21 days of repeated dosing in ob/ob mice (mean ± s.e.m.)

| | Parameter | | | |
|---|---|---|---|---|
| | Pegylated Compound 2 BIW (0.15 mg/kg) | Pegylated Compound 1 BIW (0.15 mg/kg) | Pegylated Compound 2 QW (0.3 mg/kg) | Pegylated Compound 1 QW (0.3 mg/kg) |
| Conc. at trough (ng/mL) | 175 ± 43 | 7 ± 0.7 | 38 ± 3 | 3 ± 0.1 |
| Projected Cmax (ng/mL)* | 1064 | 313 | 2149 | 633 |
| Projected AUC (µg/mL*h)* | 107 | 18 | 107 | 18 |

*Projected based on single dose pharmacokinetic data in ob/ob mice

Figure 12:
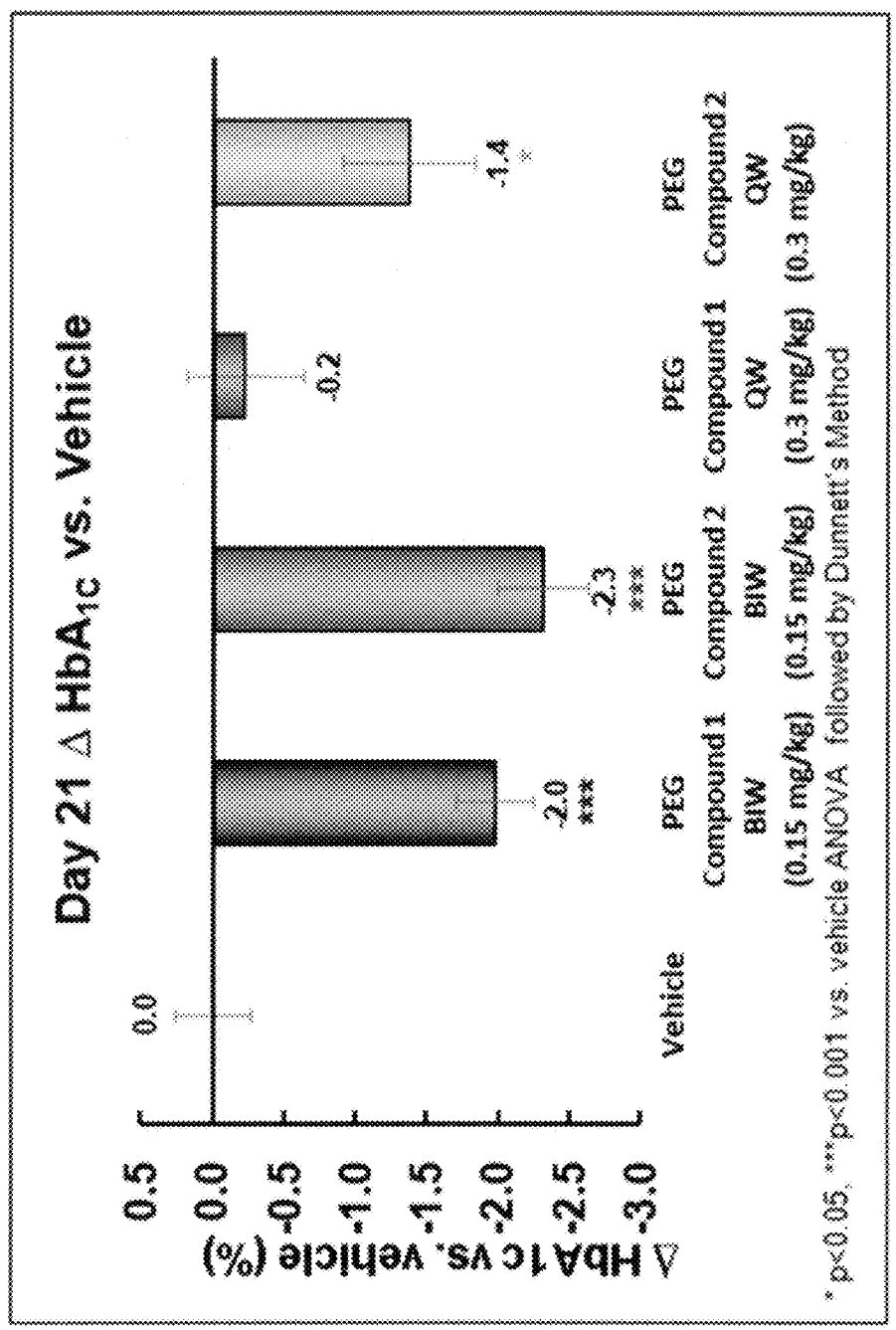
FIG. 12. Change in glycated hemoglobin (HbA1c) vs. vehicle on Day 21 of a repeated dosing study in ob/ob mice.

Glycated hemoglobin (HbA1c) is generated in vivo from the nonenzymatic addition of glucose to specific amino acids within this protein, and the percent HbA1c measured corresponds to the average blood glucose integrated over the lifetime of circulating erythrocytes. An HbA1c value greater than 6.5% is a diagnostic criterion for diabetes. The vehicle-corrected changes in HbA1c on day 21 of the repeated dosing study are shown in FIG. 12. BIW administration of 0.15 mg/kg of either FGF21 polypeptides normalized HbA1c to values less than 5% following 21 days of administration. However, only Pegylated Compound 2 statistically significantly reduced ΔHbA1c vs. vehicle with QW administration of 0.3 mg/kg, consistent with the significant increase in functional exposure to active C-terminal intact protein. These results indicate that maintenance of a target trough concentration ($C_{trough}$) can be sufficient for efficacy (Table 9).

Figure 16:
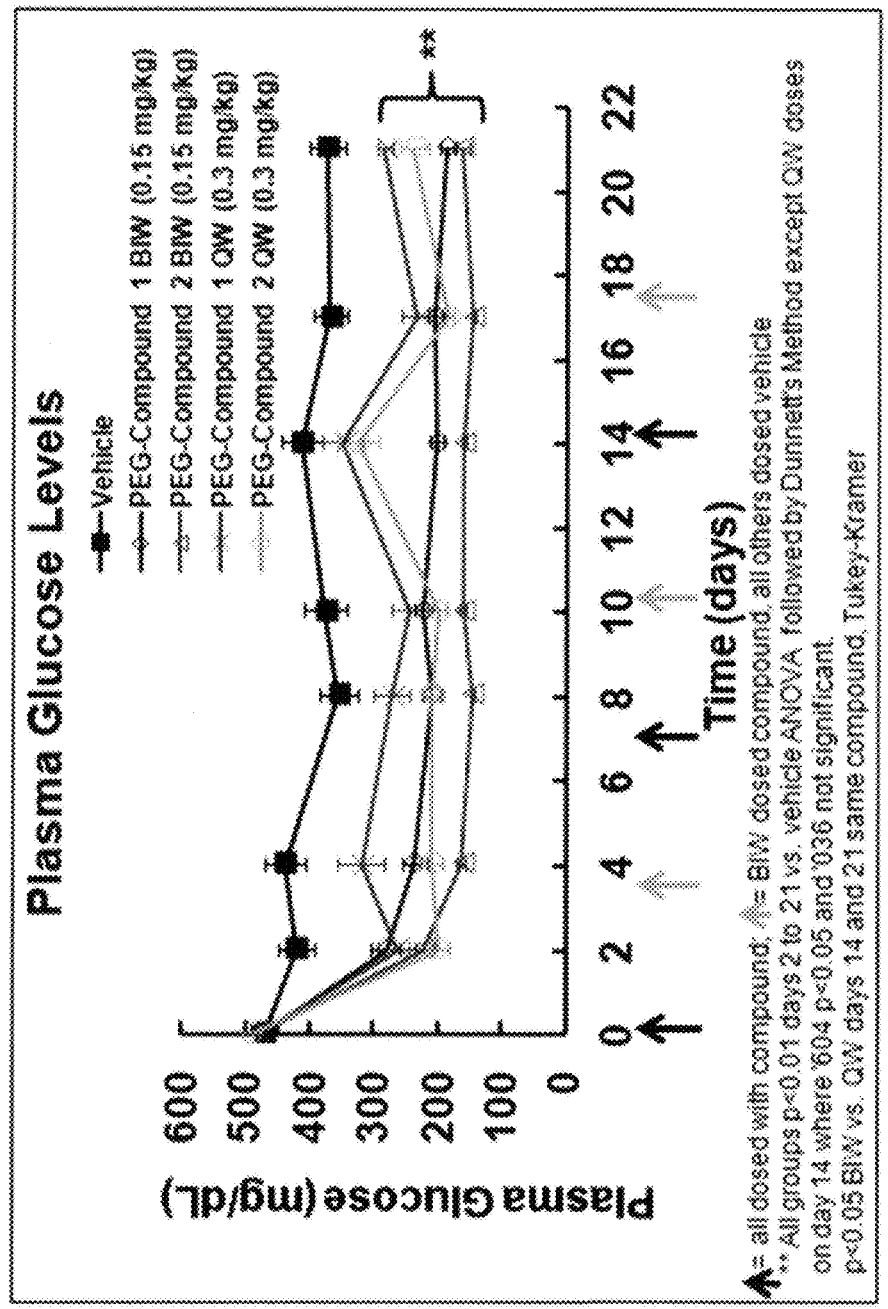
FIG. 16. Plasma glucose concentrations during a 21-day repeated dosing study in ob/ob mice.
Figure 17:
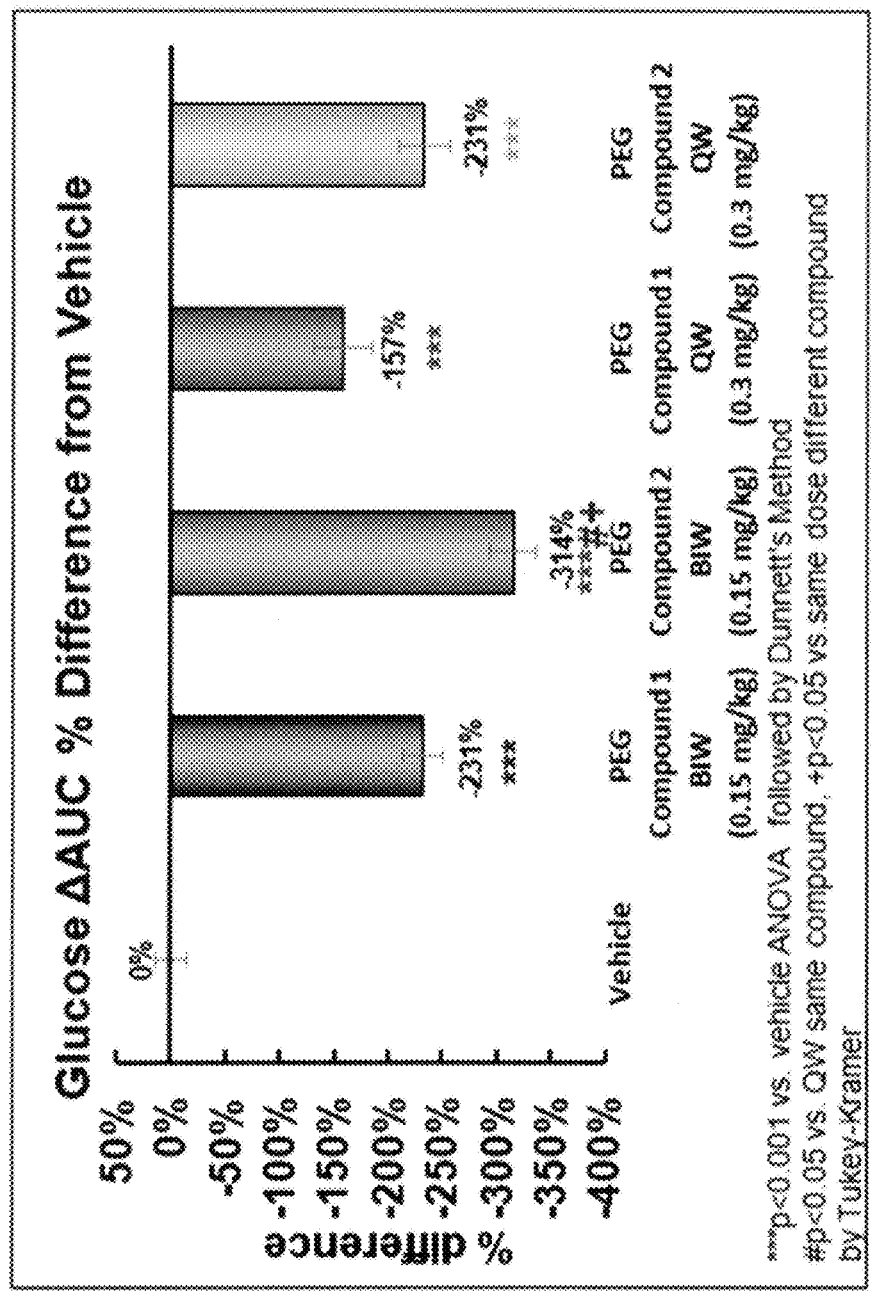
FIG. 17. Change in AUC plasma glucose concentrations during a 21-day repeated dosing study in ob/ob mice, expressed as the percentage difference from vehicle-treated controls.

Consistent with the decreased HbA1c results, plasma glucose levels were also significantly decreased throughout the study (all groups p<0.01 for days 2 to 21 versus vehicle except the QW doses on day 14, for which the Pegylated Compound 2 achieved statistical significance (p<0.05) and Pegylated Compound 1 was not significant) (FIG. 16). Overall, the change in glucose AUC (percentage difference from vehicle) was significantly decreased by all treatments over the course of the study (p<0.001 vs vehicle) (FIG. 17).

Figure 18:
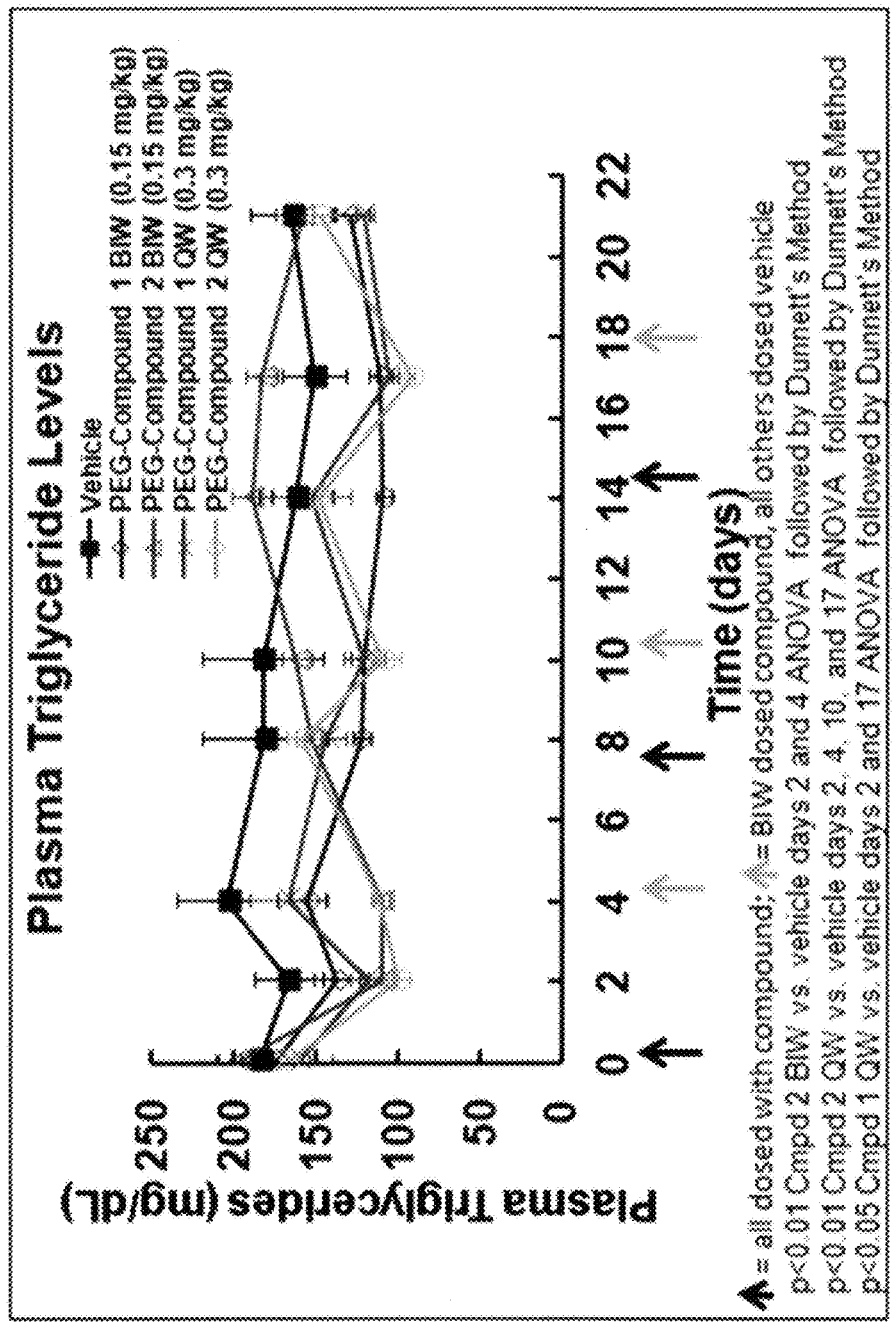
FIG. 18. Plasma triglyceride concentrations during a 21-day repeated dosing study in ob/ob mice.
Figure 39A:
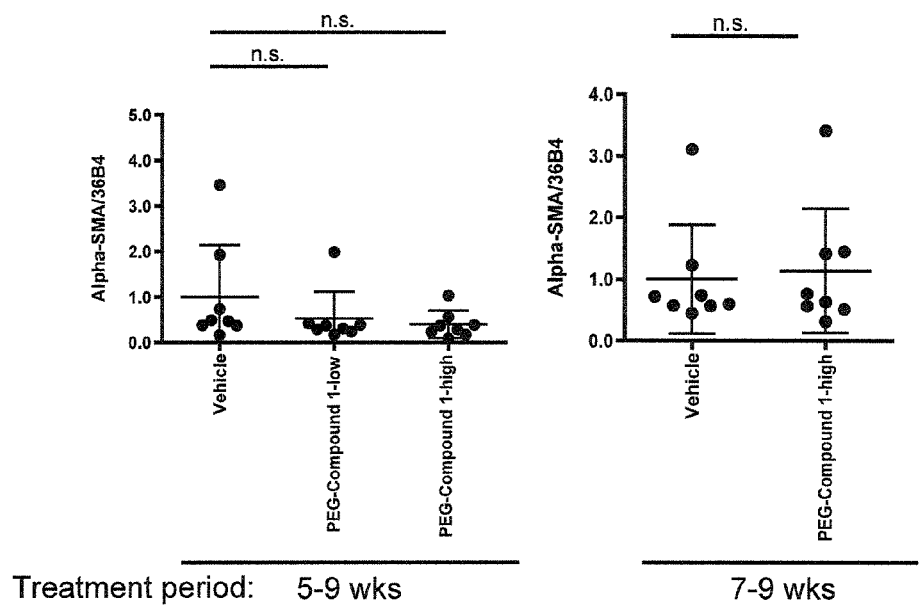
FIG. 39A-D. Relative gene expression in a Stelic NASH mouse study. Expression results for (A) Alpha-SMA, (B), TIMP-1, (C) Collagen Type 1, and (D) TGF-β.
Figure 39B:
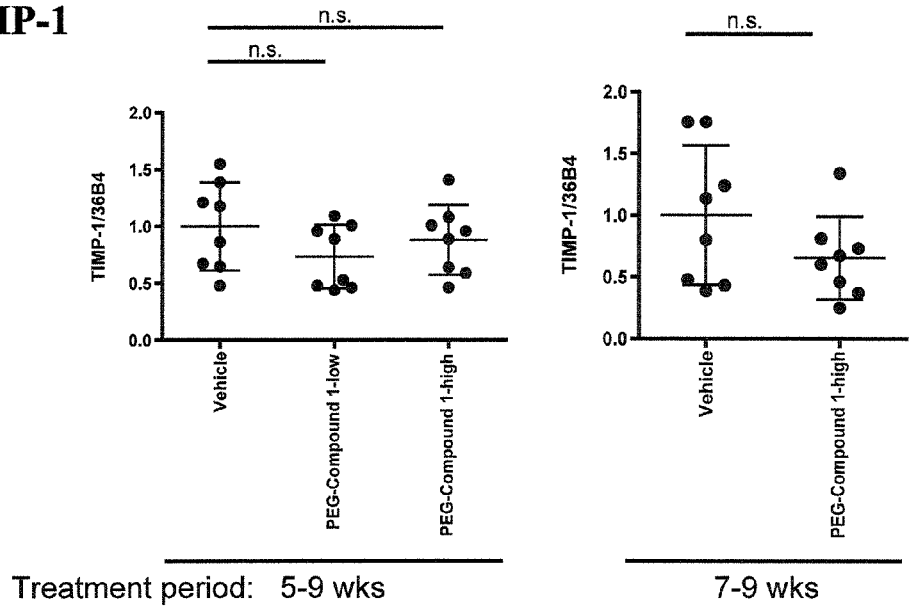
Figure 39C:
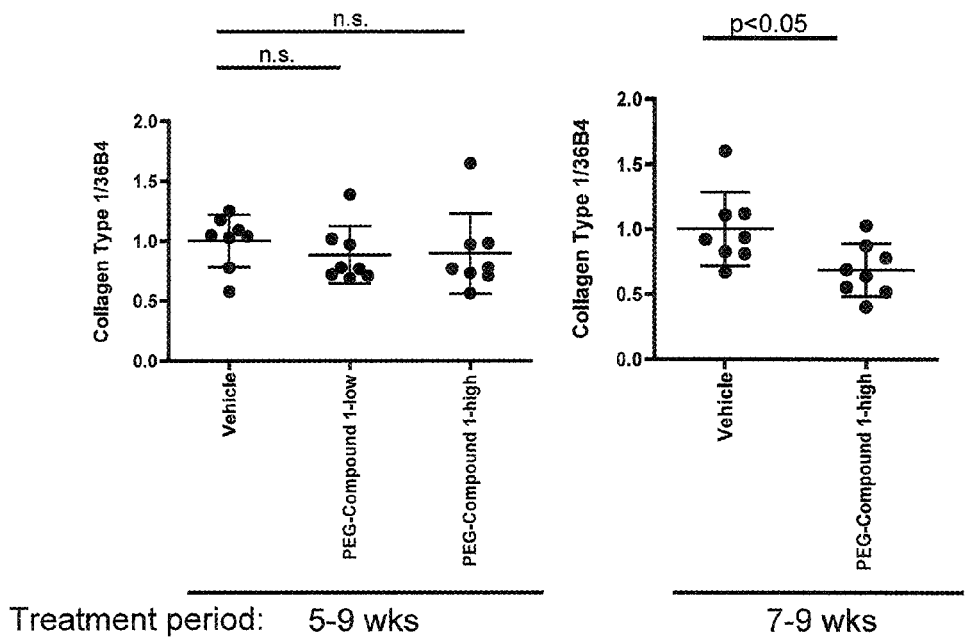
Figure 39D:
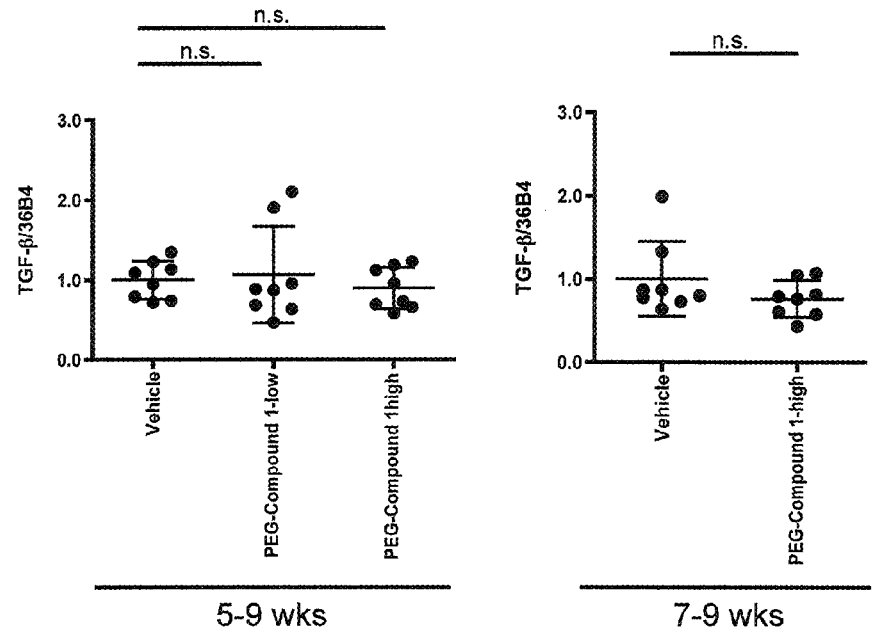

Additionally, plasma triglyceride levels were significantly reduced in the Pegylated Compound 2 group vs. vehicle, on days 2 and 4 for the BIW group (p<0.01) and on days 2, 4 and 10 and 17 for the QW group (p<0.01), as well as on days 2 and 17 for the Pegylated Compound 1 QW group (p<0.05) (FIG. 18).

Figure 13:
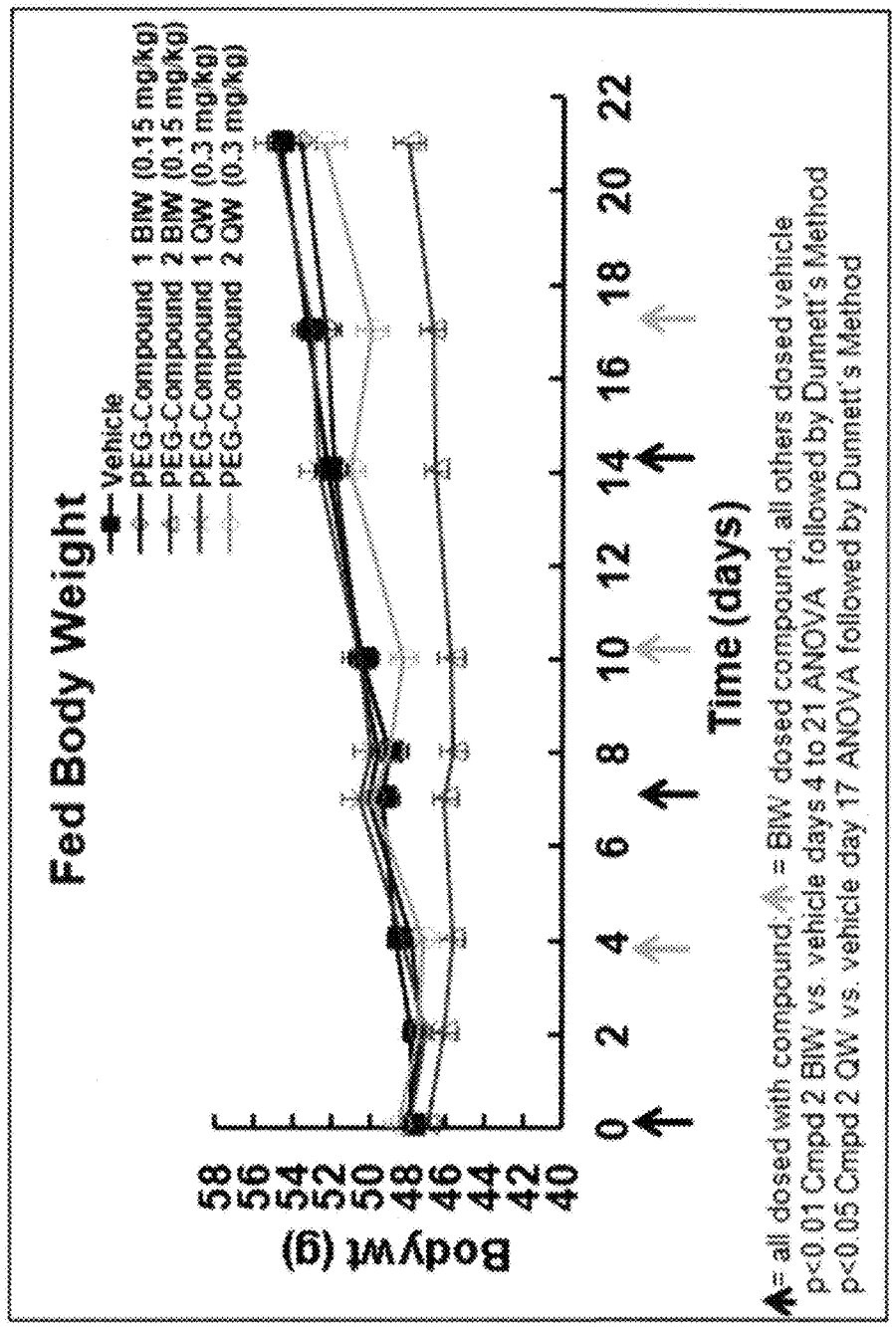
FIG. 13. Body weight over 21-days of a repeated dosing study in ob/ob mice.
Figure 14:
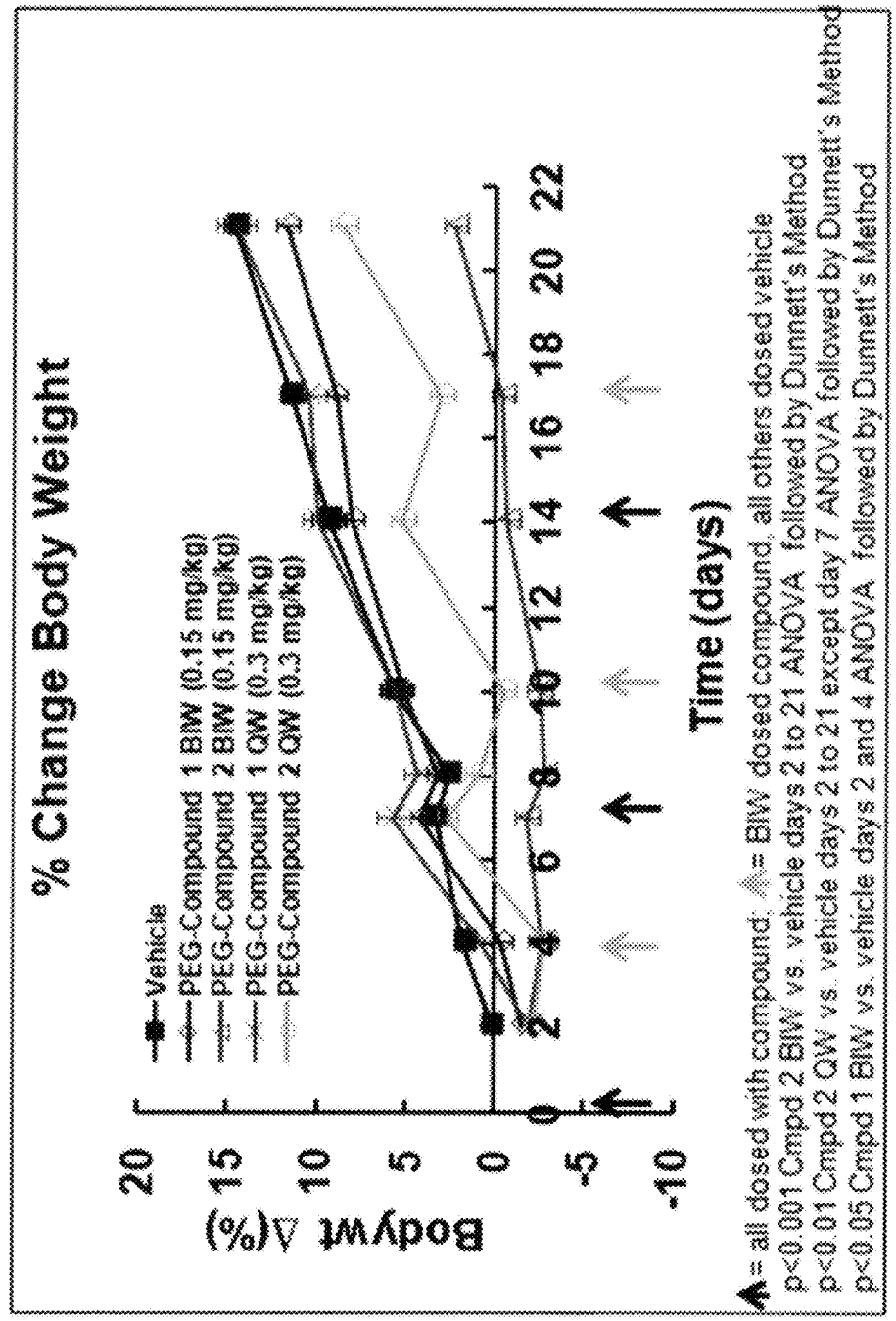
FIG. 14. Percent change in body weight over 21-days of a repeated dosing study in ob/ob mice.

Pegylated Compound 2 significantly reduced percent body weight gain relative to vehicle or Pegylated Compound 1 throughout the course of the 21-day study in ob/ob mice (FIG. 13 and FIG. 14). QW administration of 0.3 mg/kg Pegylated Compound 2 shows reduced efficacy on days 7, 14, and 21 when body weight was measured at trough, again indicating that maintenance of a target trough concentration ($C_{trough}$) can be sufficient for efficacy.

Figure 15:
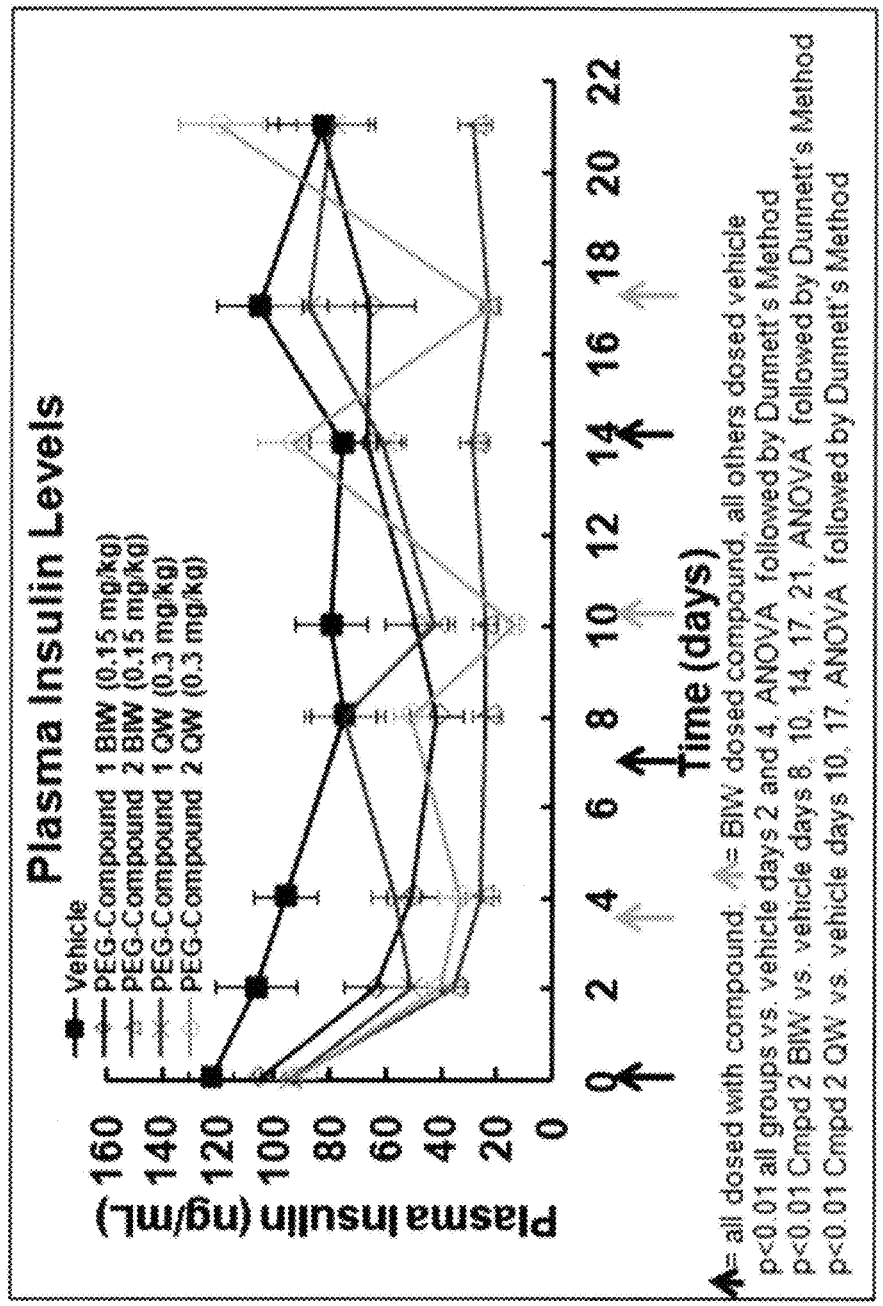
FIG. 15. Plasma insulin concentrations during a 21-day repeated dosing study in ob/ob mice.

BIW administration of 0.15 mg/kg Pegylated Compound 2 statistically significantly reduced plasma insulin levels throughout the 21-day repeated dosing study in ob/ob mice (FIG. 15); BIW Pegylated Compound 1 failed to significantly reduce plasma insulin after Day 10. QW administration of 0.3 mg/kg Pegylated Compound 2 gave rise to an apparent "saw-toothed" profile with a trend toward exceeding the values in the vehicle group on Days 14 and 21 when insulin was measured at compound trough. This pattern suggests that Pegylated Compound 2 may preserve insulin content in the pancreas with chronic dosing.

These results show that maintenance of a trough concentration of 175 ng/ml (Table 9) for Pegylated Compound 2 in the 0.15 mg/kg BIW arm resulted in significant improvements in measures of glycemia and body weight changes.

Relative to Pegylated Compound 1, the increased exposure to active C-terminal intact Pegylated Compound 2 in the ob/ob mouse model resulted in enhanced in vivo potency on a dose-basis and extended duration of action with QW administration leading to superior reductions in HbA1c, weight gain, and plasma insulin.

Example 13

Progression from fatty liver to nonalcoholic steatohepatitis (NASH) can ultimately result in liver fibrosis. This example describes the use of an FGF-21 polypeptide comprising a human FGF-21 polypeptide modified to contain a substitution of para-acetyl-L-phenylalanine for glutamine at position 108 and linked to a 30 kDa poly(ethylene glycol) (Pegylated Compound 1 or "PEG-Compound 1," SEQ ID NO:201) in a model of fibrosis. Specifically, PEG-Compound 1 was tested in the Stelic Institute's 2-hit model of NASH, in which C57BL6 mice are treated with streptozotocin shortly after birth to induce diabetes, and then placed on a high fat diet at 4 weeks of age. These mice develop fatty liver (5-weeks), NASH (7-weeks), liver fibrosis (9-weeks), and ultimately hepatocellular carcinoma (16 weeks) over a reproducible time-course. PEG-Compound 1 prevented or effectively reversed the development of NASH in the Stelic model when the mice were treated from 5- to 9-weeks of age (preventative model) or 7- to 9-weeks of age (therapeutic model). PEG-Compound 1 also decreased liver fibrosis at the 9-week time point in this study.

The sequence of PEG-Compound 1 is as follows: MHPIPDSSPLLQFGGQVRQRYLYTDDAQQTEAHLEI-REDGTVGGAADQSPESLLQLKALKPGVIQILGVKTS-RFLCQRPDGALYGSLHFDPEACSFRELLLEDGYNVY-(pAF)SEAHGLPLHLPGNKSPHRDPAPRGPARFLPLPG-LPPAPPEPPGILAPQPPDVGSSDPLSMVGPSQGRSPSY-AS (SEQ ID NO: 201), where pAF is linked to a 30 kDa PEG.

Materials and Methods

C57BL/6 mice (15-day-pregnant females) were obtained from Charles River Laboratories Japan, Inc. (Kanagawa, Japan). All animals used in the study were housed and cared for in accordance with the Japanese Pharmacological Society Guidelines for Animal Use.

The animals were maintained in a SPF facility under controlled conditions of temperature (23±2° C.), humidity (45±10%), lighting (12-hour artificial light and dark cycles; light from 8:00 to 20:00) and air exchange. A high pressure (20±4 Pa) was maintained in the experimental room to prevent contamination of the facility. The animals were housed in polycarbonate cages KN-600 (Natsume Seisakusho, Japan) with a maximum of 4 mice per cage. Sterilized PULMASμ (Material Research Center, Japan) was used for bedding and replaced once a week.

Sterilized solid high fat diet (HFD) was provided ad libitum, being placed in the metal lid on top of the cage. Pure water was provided ad libitum from a water bottle equipped with a rubber stopper and a sipper tube. Water bottles were replaced once a week, cleaned and sterilized in autoclave and reused.

NASH was induced in 40 male mice by a single subcutaneous injection of 200 μg streptozotocin (STZ, Sigma-Aldrich Co. LLC., USA) solution 2 days after birth and feeding with high fat diet (HFD, 57 kcal % fat, cat #: HFD32, CLEA Japan, Inc., Japan) after 4 weeks of age ("STAM mice"). Food consumption was measured daily per week during the treatment period.

PEG-Compound 1 and vehicle (20 mM Tris/250 mM sucrose, pH 8.3) were administered by subcutaneous route in a volume of 1 mL/kg. PEG-Compound 1 was administered at doses of 1 and 3 mg/kg twice per week.

Non-fasting blood glucose was measured in whole blood using LIFE CHECK (EIDIA Co.

Ltd., Japan). For plasma biochemistry, blood was collected in polypropylene tubes with anticoagulant (Novo-Heparin, Mochida Pharmaceutical Co. Ltd., Japan) and centrifuged at 1,000×g for 15 minutes at 4° C. The supernatant was collected and stored at −80° C. until use. Plasma Alanine aminotransferase (ALT), triglyceride and total cholesterol levels were measured by FUJI DRI-CHEM 7000 (Fujifilm Corporation, Japan).

Liver total lipid-extracts were obtained by Folch's method (Folch J. et al., J. Biol. Chem. 1957; 226: 497). Liver samples were homogenized in chloroform-methanol (2:1, v/v) and incubated overnight at room temperature. After washing with chloroform-methanol-water (8:4:3, v/v/v), the extracts were evaporated to dryness, and dissolved in isopropanol. Liver triglyceride and cholesterol contents were measured by Triglyceride E-test and Cholesterol E-test, respectively (Wako Pure Chemical Industries, Ltd., Japan).

For hematoxylin and eosin (HE) staining, sections were cut from paraffin blocks of liver tissue prefixed in Bouin's solution and stained with Lillie-Mayer's Hematoxylin (Muto Pure Chemicals Co., Ltd., Japan) and eosin solution (Wako Pure Chemical Industries). Nonalcoholic fatty liver disease (NAFLD) Activity score (NAS) was calculated according to the criteria of Kleiner (Kleiner D E. et al., Hepatology, 2005; 41:1313). To visualize macro- and microvesicular fat, cryosections were cut from frozen liver tissues, prefixed in 10% neutral buffered formalin, embedded in Tissue-Tek O.C.T. compound (Sakura Finetek Japan Co. Ltd., Japan), and stained with Oil Red 0 (Sigma-Aldrich). For immunohistochemistry, sections were cut from frozen liver tissues embedded in Tissue-Tek O.C.T. compound and fixed in acetone. Endogenous peroxidase activity was blocked using 0.03% H2O2 for 5 minutes, followed by incubation with Block Ace (Dainippon Sumitomo Pharma Co. Ltd., Japan) for 10 minutes. The sections were incubated with a 200-fold dilution of anti-F4/80 antibody (BMA Biomedicals, Switzerland) over night at room temperature. After incubation with secondary antibody (HRP-Goat anti-rat antibody, Invitrogen, USA), enzyme-substrate reactions were performed using 3,3'-diaminobenzidine/H2O2 solution (Nichirei Bioscience Inc., Japan).

For quantitative analysis of fibrosis, fat deposition and inflammation areas, bright field images of Sirius red-stained, oil red-stained and F4/80-immunostained sections were captured around the central vein using a digital camera (DFC280; Leica, Germany) at 200-fold magnification, and the positive areas in 5 fields/section were measured using ImageJ software (National Institute of Health, USA).

For quantitative PCR, Total RNA was extracted from liver samples using RNAiso (Takara Bio Inc., Japan) according to the manufacturer's instructions. One μg of RNA was reverse-transcribed using a reaction mixture containing 4.4 mM MgCl2 (F. Hoffmann-La Roche Ltd., Switzerland), 40 U RNase inhibitor (Toyobo Co., Ltd., Japan), 0.5 mM dNTP (Promega Corporation, USA), 6.28 μM random hexamer (Promega Corporation), 5× first strand buffer (Promega), 10 mM dithiothreitol (Invitrogen) and 200 U MMLV-RT (Invitrogen) in a final volume of 20 μL. The reaction was carried out for 1 hour at 37° C., followed by 5 minutes at 99° C. Real-time PCR was performed using real-time PCR DICE and SYBR premix Taxi (Takara Bio). To calculate the relative mRNA expression level, the expression of each gene was normalized to that of reference gene 36B4 (gene symbol: Rplp0). PCR-primer sequences were as follows: 36B4: forward 5'-TTCCAGGCTTTGGGCATCA-3'; reverse 5'-ATGTTCAGCATGTTCAGCAGTGTG-3'; Alpha-SMA: forward 5'-AAGAGCATCCGACACTGCTGAC-3'; reverse 5'-AGCACAGCCTGAATAGCCACATAC-3'; TIMP-1: forward 5'-TGAGCCCTGCTCAGCAAAGA-3'; reverse 5'-GAGGACCTGATCCGTCCACAA-3'; Collagen Type 1: forward 5'-CCAACAAGCATGTCTGGTTAGGAG-3'; reverse 5'-GCAATGCTGTTCTTGCAGTGGTA-3'; TGF-beta: MA030397 forward 5'-GTGTGGAGCAACATGTG-GAACTCTA-3'; reverse 5'-TTGGTTCAGCCACTGC-CGTA-3'. Gene identities are as follows: 36B4: Ribosomal protein, large, P0, Alpha-SMA: Musculus actin, alpha 2, smooth muscle, aorta (Acta2), Timp-1: Musculus tissue inhibitor of metalloproteinase 1 (Timp1), transcript variant 1, Collagen Type 1: Musculus collagen, type I, alpha 2 (Col1a2), TGF-beta: transforming growth factor beta.

For the treatment period 5-9 weeks, statistical analyses were performed using the Bonferroni Multiple Comparison Test using GraphPad Prism 4 (GraphPad Software Inc., USA). For the treatment period 7-9 weeks, t Statistical analyses were performed using Student's t-test using Graph-Pad Prism 4. P values <0.05 were considered statistically significant. A trend or tendency toward statistical significance was identified when a one-tailed t-test returned P values <0.10. Results were expressed as mean±standard deviation (SD).

Each study group contained 8 STAM mice treated subcutaneously with either vehicle or PEG-Compound 1 in a volume of 1 mL/kg twice per week. Animals were sacrificed at 9 weeks. Study groups were as follows:

Group 1: Vehicle. Eight NASH mice were subcutaneously administered vehicle in a volume of 1 mL/kg twice per week from 5 to 9 week of age.

Group 2: PEG-Compound 1-low dose. Eight NASH mice were subcutaneously administered vehicle supplemented with PEG-Compound 1 at a dose of 1 mg/kg twice per week from 5 to 9 weeks of age.

Group 3: PEG-Compound 1-high dose. Eight NASH mice were subcutaneously administered vehicle supplemented with PEG-Compound 1 at a dose of 3 mg/kg twice per week from 5 to 9 weeks of age.

Group 4: Vehicle. Eight NASH mice were subcutaneously administered vehicle in a volume of 1 mL/kg twice per week from 7 to 9 week from of age.

Group 5: PEG-Compound 1-high dose. Eight NASH mice were subcutaneously administered vehicle supplemented with PEG-Compound 1 at a dose of 3 mg/kg twice per week from 7 to 9 weeks of age.

The viability, clinical signs and behavior were monitored daily. Body weight was recorded before the treatment. Mice were observed for significant clinical signs of toxicity, moribundity and mortality approximately 60 minutes after each administration. At the end of the study, the animals were sacrificed by exsanguination through direct cardiac puncture under ether anesthesia (Wako Pure Chemical Industries).

Results

Body weight changes are shown in FIG. 19.

For the treatment period 5-9 weeks (groups 1, 2, and 3) body weight gradually increased during the treatment period. Mean body weight of the PEG-Compound 1-low group was significantly lower than that of the vehicle group at day 11, 13, 15, 16, 18, 19, 20 and from day 22 to day 28. Mean body weight of the PEG-Compound 1-high group was significantly lower than that of the vehicle group from day 10 to day 28. None of the animals showed deterioration in general condition.

For the treatment period 7-9 weeks (groups 4 and 5) body weight gradually increased during the treatment period. Mean body weight of the PEG-Compound 1-high group was significantly lower than that of the vehicle group at day 5, 6, 9 and from day 11 to day 14. None of the animals showed deterioration in general condition.

Total food consumption is shown in FIG. 20.

For the treatment period 5-9 weeks (groups 1, 2, and 3), there were no significant differences in total food consumption between the vehicle group and the PEG-Compound 1 treatment groups (Vehicle: 130±4 g/mouse, PEG-Compound 1-low: 130±3 g/mouse, PEG-Compound 1-high: 131±3 g/mouse).

For the treatment period 7-9 weeks (groups 4 and 5), the total food consumption tended to increase in the PEG-Compound 1-high group compared with the vehicle group (Vehicle: 62±3 g/mouse, PEG-Compound 1-high: 68±2 g/mouse).

Body weight at the time of sacrifice is shown in FIG. 21 and Table 10.

For the treatment period 5-9 weeks (groups 1, 2, and 3), at the time of sacrifice the PEG-Compound 1 treatment groups showed a significant decrease in mean body weight compared with the vehicle group (Vehicle: 21.7±1.4 g, PEG-Compound 1-low: 19.5±1.4 g, PEG-Compound 1-high: 18.9±1.6 g).

For the treatment period 7-9 weeks (groups 4 and 5), at the time of sacrifice the PEG-Compound 1-high group showed a significant decrease in mean body weight compared with the vehicle group (Vehicle: 21.5±1.4 g, PEG-Compound 1-high: 19.8±1.0 g).

Liver weight and liver-to-body weight ratio are shown in FIG. 22 and FIG. 23 and Table 10).

For the treatment period 5-9 weeks (groups 1, 2, and 3), the PEG-Compound 1 treatment groups showed a significant decrease in mean liver weight compared with the vehicle group (Vehicle: 1511±66 mg, PEG-Compound 1-low: 1163±117 mg, PEG-Compound 1-high: 970±237 mg). The PEG-Compound 1 treatment groups showed a significant decrease in mean liver-to-body weight ratio compared with the vehicle group (Vehicle: 7.0±0.4%, PEG-Compound 1-low: 6.0±0.5%, PEG-Compound 1-high: 5.1±0.9%).

For the treatment period 7-9 weeks (groups 4 and 5), the PEG-Compound 1-high group showed a significant decrease in mean liver weight compared with the vehicle group (Vehicle: 1364±126 mg, PEG-Compound 1-high: 1008±135 mg). The PEG-Compound 1-high group showed a significant decrease in mean liver-to-body weight ratio compared with the vehicle group (Vehicle: 6.4±0.5%, PEG-Compound 1-high: 5.1±0.8%).

TABLE 10

Body weight and liver weight.

| | Vehicle (5-9 wks treatment) (n = 8) | PEG-Compound 1-low (5-9 wks treatment) (n = 8) | PEG-Compound 1-high (5-9 wks treatment) (n = 8) | Vehicle (7-9 wks treatment) (n = 8) | PEG-Compound 1-high (7-9 wks treatment) (n = 8) |
|---|---|---|---|---|---|
| Body weight (g) | 21.7 ± 1.4 | 19.5 ± 1.4 | 18.9 ± 1.6 | 21.5 ± 1.4 | 19.8 ± 1.0 |
| Liver weight (mg) | 1511 ± 66 | 1163 ± 117 | 970 ± 237 | 1364 ± 126 | 1008 ± 135 |
| Liver-to-body weight ratio (%) | 7.0 ± 0.4 | 6.0 ± 0.5 | 5.1 ± 0.9 | 6.4 ± 0.5 | 5.1 ± 0.8 |

Whole blood glucose is shown in FIG. 24 and Table 11.

For the treatment period 5-9 weeks (groups 1, 2, and 3), the PEG-Compound 1-high group showed a significant decrease in mean whole blood glucose compared with the vehicle group. The blood glucose levels tended to decrease in the PEG-Compound 1-low group compared with the vehicle group (Vehicle: 691±114 mg/dL, PEG-Compound 1-low: 566±119 mg/dL, PEG-Compound 1-high: 493±136 mg/dL).

For the treatment period 7-9 weeks (groups 4 and 5), the PEG-Compound 1-high group showed a significant decrease in mean whole blood glucose compared with the vehicle group (Vehicle: 656±85 mg/dL, PEG-Compound 1-high: 454±104 mg/dL).

Plasma ALT is shown in FIG. 25 and Table 11.

For the treatment period 5-9 weeks (groups 1, 2, and 3), there were no significant differences in plasma ALT levels between the vehicle group and the PEG-Compound 1 treatment groups (Vehicle: 82±66 U/L, PEG-Compound 1-low: 64±36 U/L, PEG-Compound 1-high: 108±78 U/L).

For the treatment period 7-9 weeks (groups 4 and 5), the plasma ALT levels tended to decrease in the PEG-Compound 1-high group compared with the vehicle group (Vehicle: 229±285 U/L, PEG-Compound 1-high: 36±8 U/L).

Plasma triglyceride levels are shown in FIG. 26 and Table 11.

For the treatment period 5-9 weeks (groups 1, 2, and 3), the PEG-Compound 1 treatment groups showed a significant decrease in plasma triglyceride levels compared with the vehicle group (Vehicle: 322±341 mg/dL, PEG-Compound 1-low: 75±39 mg/dL, PEG-Compound 1-high: 64±22 mg/dL).

For the treatment period 7-9 weeks (groups 4 and 5), the PEG-Compound 1-high group showed a significant decrease in plasma triglyceride levels compared with the vehicle group (Vehicle: 139±39 mg/dL, PEG-Compound 1-high: 59±51 mg/dL).

Plasma total cholesterol levels are shown in FIG. 27 and Table 11.

For the treatment period 5-9 weeks (groups 1, 2, and 3), the plasma total cholesterol levels tended to decrease in the PEG-Compound 1-high group compared with the vehicle group. There were no significant differences in plasma total cholesterol levels between the vehicle group and the PEG-Compound 1-low group (Vehicle: 121±20 mg/dL, PEG-Compound 1-low: 114±19 mg/dL, PEG-Compound 1-high: 98±31 mg/dL).

For the treatment period 7-9 weeks (groups 4 and 5), there were no significant differences in plasma total cholesterol levels between the vehicle group and the PEG-Compound 1-high group (Vehicle: 121±19 mg/dL, PEG-Compound 1-high: 115±29 mg/dL).

Liver triglyceride content is shown in FIG. 28 and Table 11.

For the treatment period 5-9 weeks (groups 1, 2, and 3), the PEG-Compound 1 treatment groups showed a significant decrease in liver triglyceride contents compared with the vehicle group (Vehicle: 54±13 mg/g liver, PEG-Compound 1-low: 25±7 mg/g liver, PEG-Compound 1-high: 22±9 mg/g liver).

For the treatment period 7-9 weeks (groups 4 and 5), the PEG-Compound 1-high group showed a significant decrease in liver triglyceride contents compared with the vehicle group (Vehicle: 53±11 mg/g liver, PEG-Compound 1-high: 17±6 mg/g liver).

Liver cholesterol content is shown in FIG. 29 and Table 11.

For the treatment period 5-9 weeks (groups 1, 2, and 3), there were no significant differences in liver cholesterol contents between the vehicle group and the PEG-Compound 1 treatment groups (Vehicle: 2.9±0.7 mg/g liver, PEG-Compound 1-low: 2.9±0.6 mg/g liver, PEG-Compound 1-high: 3.1±0.4 mg/g liver).

For the treatment period 7-9 weeks (groups 4 and 5), there were no significant differences in liver cholesterol contents between the vehicle group and the PEG-Compound 1 treatment groups (Vehicle: 3.1±0.8 mg/g liver, PEG-Compound 1-high: 3.6±1.5 mg/g liver).

TABLE 11

Blood and liver biochemistry.

| | Parameter (mean ± SD) | | | | |
|---|---|---|---|---|---|
| | Vehicle (5-9 wks treatment) (n = 8) | PEG-Compound 1-low (5-9 wks treatment) (n = 8) | PEG-Compound 1-high (5-9 wks treatment) (n = 8) | Vehicle (7-9 wks treatment) (n = 8) | PEG-Compound 1-high (7-9 wks treatment) (n = 8) |
| Whole blood glucose (mg/dL) | 691 ± 114 | 566 ± 119 | 493 ± 136 | 656 ± 85 | 454 ± 104 |
| Plasma ALT (U/L) | 82 ± 66 | 64 ± 36 | 108 ± 78 | 229 ± 285 | 36 ± 8 |
| Plasma triglyceride (mg/dL) | 322 ± 341 | 75 ± 39 | 64 ± 22 | 139 ± 39 | 59 ± 51 |
| Plasma total cholesterol (mg/dL) | 121 ± 20 | 114 ± 19 | 98 ± 31 | 121 ± 19 | 115 ± 29 |
| Liver triglyceride (mg/g liver) | 54 ± 13 | 25 ± 7 | 22 ± 9 | 53 ± 11 | 17 ± 6 |
| Liver cholesterol (mg/g liver) | 2.9 ± 0.7 | 2.9 ± 0.6 | 3.1 ± 0.4 | 3.1 ± 0.8 | 3.6 ± 1.5 |

Histological Analyses: HE Staining and NAFLD Activity Score

Representative photomicrographs of the HE-stained sections are shown in FIG. 30A-B, and results of NAFLD Activity scores are shown in FIG. 31, FIG. 32A-C and Table 12. (The NALFD Activity Score (FIG. 31) is a composite of steatosis, hepatocyte ballooning, and lobular inflammation scores). The results shown in Table 12 were based upon the scoring criteria shown in Table 13.

TABLE 13

Definition of NAS Components

| Item | Score | Extent |
|---|---|---|
| Steatosis | 0 | <5% |
| | 1 | 5-33% |
| | 2 | >33-66% |
| | 3 | >66% |
| Hepatocyte Ballooning | 0 | None |
| | 1 | Few balloon cells |
| | 2 | Many cells/prominent ballooning |

TABLE 12

NAFLD Activity score.

| | | Score | | | | | | | | | | |
|---|---|---|---|---|---|---|---|---|---|---|---|---|
| | | Steatosis | | | | Lobular Inflammation | | | | Hepatocyte Ballooning | | NAS |
| Group | n | 0 | 1 | 2 | 3 | 0 | 1 | 2 | 3 | 0 | 1 | 2 | (mean ± SD) |
| Vehicle (5-9 wks treatment) | 8 | — | 6 | 2 | — | — | — | 5 | 3 | — | — | 8 | 5.6 ± 0.7 |
| PEG-Compound 1-low (5-9 wks treatment) | 8 | 3 | 5 | — | — | — | 4 | 4 | — | — | 1 | 7 | 4.0 ± 1.2 |
| PEG-Compound 1-high (5-9 wks treatment) | 8 | 4 | 4 | — | — | — | 5 | 3 | — | 2 | 4 | 2 | 2.9 ± 1.2 |
| Vehicle (7-9 wks treatment) | 8 | — | 5 | 3 | — | — | — | 6 | 2 | — | — | 8 | 5.6 ± 0.7 |
| PEG-Compound 1-high (7-9 wks treatment) | 8 | 5 | 3 | — | — | — | 6 | 2 | — | 3 | 4 | 1 | 2.4 ± 1.3 |

TABLE 13-continued

Definition of NAS Components

| Item | Score | Extent |
|---|---|---|
| Lobular Inflammation | 0 | No foci |
| | 1 | <2 foci/200x |
| | 2 | 2-4 foci/200x |
| | 3 | >4 foci/200x |

For the treatment period 5-9 weeks (groups 1, 2, and 3), liver sections from the vehicle group exhibited severe micro- and macrovesicular fat deposition, hepatocellular ballooning and inflammatory cell infiltration. The PEG-Compound 1 treatment groups showed marked improvements (decreases) in fat deposition, hepatocellular ballooning and inflammatory cell infiltration, with significant reduction in NAFLD Activity score (NAS) compared with the vehicle group (Vehicle: 5.6±0.7, PEG-Compound 1-low: 4.0±1.2, PEG-Compound 1-high: 2.9±1.2).

For the treatment period 7-9 weeks (groups 4 and 5), the PEG-Compound 1-high group showed marked improvements (decreases) in fat deposition, hepatocellular ballooning and inflammatory cell infiltration, with significant reduction in NAS compared with the vehicle group (Vehicle: 5.6±0.7, PEG-Compound 1-high: 2.4±1.3).

liver lobule. There were no significant differences in the number and size of F4/80+ cells between the vehicle group and the PEG-Compound 1 treatment groups, as well as in the percentage of inflammation area (F4/80-positive area) (Vehicle: 6.9±0.9%, PEG-Compound 1-low: 7.6±1.5%, PEG-Compound 1-high: 7.1±0.7%).

For the treatment period 7-9 weeks (groups 4 and 5), there were no significant differences in the number and size of F4/80+ cells between the vehicle group and the PEG-Compound 1-high group, as well as in the percentage of inflammation area (Vehicle: 7.1±0.7%, PEG-Compound 1-high: 6.3±1.1%).

Histological Analysis: Oil Red Staining

Results of oil red staining are shown in FIG. 37A-B (showing representative staining), FIG. 38 and Table 14.

For the treatment period 5-9 weeks (groups 1, 2, and 3), liver sections from the vehicle group exhibited micro- and macrovesicular fat deposition in the hepatocytes. The percentage of fat deposition area (oil red-positive area) significantly decreased in the PEG-Compound 1 treatment groups compared with the vehicle group (Vehicle: 30.4±4.8%, PEG-Compound 1-low: 20.5±8.8%, PEG-Compound 1-high: 16.2±6.1%).

For the treatment period 7-9 weeks (groups 4 and 5), the percentage of fat deposition area significantly decreased in the PEG-Compound 1-high group compared with the vehicle group (Vehicle: 30.7±5.6%, PEG-Compound 1-high: 13.9±7.7%).

TABLE 14

Histological analyses

| | Parameter (mean ± SD) | | | | |
|---|---|---|---|---|---|
| | Vehicle (5-9 wks treatment) (n = 8) | PEG-Compound 1-low (5-9 wks treatment) (n = 8) | PEG-Compound 1-high (5-9 wks treatment) (n = 8) | Vehicle (7-9 wks treatment) (n = 8) | PEG-Compound 1-high (7-9 wks treatment) (n = 8) |
| Sirius red-positive area (%) | 1.10 ± 0.24 | 0.71 ± 0.17 | 0.71 ± 0.19 | 1.25 ± 0.29 | 0.75 ± 0.21 |
| F4/80-positive area (%) | 6.9 ± 0.9 | 7.6 ± 1.5 | 7.1 ± 0.7 | 7.1 ± 0.7 | 6.3 ± 1.1 |
| Oil red-positive area (%) | 30.4 ± 4.8 | 20.5 ± 8.8 | 16.2 ± 6.1 | 30.7 ± 5.6 | 13.9 ± 7.7 |

Histological Analyses: Sirius Red Staining

Results of Sirius red staining are shown in FIG. 33A-B, FIG. 34 (showing representative staining) and Table 14.

For the treatment period 5-9 weeks (groups 1, 2, and 3), liver sections from the vehicle group exhibited collagen deposition in the pericentral region of the liver lobule. The fibrosis area (Sirius red-positive area) significantly decreased in the PEG-Compound 1 treatment groups compared with the vehicle group (Vehicle: 1.10±0.24%, PEG-Compound 1-low: 0.71±0.17%, PEG-Compound 1-high: 0.71±0.19%).

For the treatment period 7-9 weeks (groups 4 and 5), the fibrosis area significantly decreased in the PEG-Compound 1-high group compared with vehicle group (Vehicle: 1.25±0.29%, PEG-Compound 1-high: 0.75±0.21%).

Histological Analyses: F4/80 Immunohistochemistry

Result of F4/80 immunohistochemistry are shown in FIG. 35A-B, FIG. 36 (showing representative staining) and Table 14.

For the treatment period 5-9 weeks (groups 1, 2, and 3), F4/80 immunostaining of liver sections form the vehicle group demonstrated accumulation of F4/80+ cells in the Gene Expression Analyses Results of gene expression analysis are shown in FIG. 39A-D and Table 15 for alpha-SMA, TIMP-1, Collagen Type 1, and TGF-beta.

For the treatment period 5-9 weeks (groups 1, 2, and 3), alpha-SMA mRNA expression levels tended to be down-regulated in the PEG-Compound 1-high group compared with the vehicle group. There were no significant differences in α-SMA mRNA expression levels between the vehicle group and the PEG-Compound 1-low group (Vehicle: 1.00±1.14, PEG-Compound 1-low: 0.52±0.60, PEG-Compound t-high: 0.39±0.30).

For the treatment period 7-9 weeks (groups 4 and 5), there were no significant differences in α-SMA mRNA expression levels between the vehicle group and the PEG-Compound 1-high group (Vehicle: 1.00±0.88, PEG-Compound 1-high: 1.14±1.01).

For the treatment period 5-9 weeks (groups 1, 2, and 3), TIMP-1 mRNA expression levels tended to be down-regulated in the PEG-Compound 1-low group compared with the vehicle group. There were no significant differences in TIMP-1 mRNA expression levels between the vehicle group and the PEG-Compound 1-high group (Vehicle: 1.00±0.39, PEG-Compound 1-low: 0.73±0.28, PEG-Compound 1-high: 0.88±0.31).

For the treatment period 7-9 weeks (groups 4 and 5), TIMP-1 mRNA expression levels tended to be down-regulated in the PEG-Compound 1-high group compared with the vehicle group (Vehicle: 1.00±0.57, PEG-Compound 1-high: 0.65±0.34).

For the treatment period 5-9 weeks (groups 1, 2, and 3), there were no significant differences in Collagen Type 1 mRNA expression levels between the vehicle group and the PEG-Compound 1 treatment groups (Vehicle: 1.00±0.22, PEG-Compound 1-low: 0.88±0.24, PEG-Compound 1-high: 0.89±0.34).

For the treatment period 7-9 weeks (groups 4 and 5), the Collagen Type 1 mRNA expression significantly decreased in the PEG-Compound 1-high group compared with the vehicle group (Vehicle: 1.00±0.29, PEG-Compound 1-high: 0.69±0.20).

For the treatment period 5-9 weeks (groups 1, 2, and 3), TGF-β mRNA expression levels tended to be down-regulated in the PEG-Compound 1-low group compared with the vehicle group. There were no significant differences in TGF-β mRNA expression levels between the vehicle group and the PEG-Compound 1-high group (Vehicle: 1.00±0.24, PEG-Compound 1-low: 1.07±0.60, PEG-Compound 1-high: 0.90±0.26).

For the treatment period 7-9 weeks (groups 4 and 5), TGF-β mRNA expression levels tended to be down-regulated in the PEG-Compound 1-high group compared with the vehicle group (Vehicle: 1.00±0.45, PEG-Compound 1-high: 0.77±0.22).

Discussion

This example shows the results of experiments that tested the efficacy of PEG-Compound 1 in both a preventative and a therapeutic model of NASH. In the preventative model, treatment was initiated at the time fatty liver was evident in this model (starting from week 5, i.e., week 5-9 groups). In the therapeutic model, treatment was initiated at the time NASH was evident in this model (starting from week 7, i.e., week 7-9 groups). Thus, therapeutic efficacy of PEG-Compound 1 was demonstrated in both the preventative and therapeutic models.

Treatment with PEG-Compound 1 significantly reduced the fibrosis area (detected by Sirius red staining) in both treatment models, demonstrating the anti-fibrotic effect of PEG-Compound 1. PEG-Compound 1 treatment also reduced the mRNA expression levels of α-SMA, TIMP-1 and Collagen Type 1, further supporting the anti-fibrotic properties of PEG-Compound 1. Treatment with PEG-Compound 1 also caused statistically significant decreases in body and liver weight, liver-to-body weight ratio, blood glucose, plasma and liver triglycerides, NAFLD activity score, fat deposition area (detected by oil red staining).

All PEG-Compound 1 treatment groups showed a significant reduction of NAS, which is one of the clinical endpoints for assessing the activity of NASH (Sanyal A J. et al., Hepatology, 2011; 54:344).

Furthermore, treatment with PEG-Compound 1 improved lipid and glucose metabolism as evidenced by reduction of whole blood glucose levels, plasma triglyceride levels and liver triglyceride contents.

TABLE 15

Gene expression analyses

| | Parameter (mean ± SD) | | | | |
|---|---|---|---|---|---|
| | Vehicle (5-9 wks treatment) (n = 8) | PEG-Compound 1-low (5-9 wks treatment) (n = 8) | PEG-Compound 1-high (5-9 wks treatment) (n = 8) | Vehicle (7-9 wks treatment) (n = 8) | PEG-Compound 1-high (7-9 wks treatment) (n = 8) |
| Alpha-SMA | 1.00 ± 1.14 | 0.52 ± 0.60 | 0.39 ± 0.30 | 1.00 ± 0.88 | 1.14 ± 1.01 |
| TIMP-1 | 1.00 ± 0.39 | 0.73 ± 0.28 | 0.88 ± 0.31 | 1.00 ± 0.57 | 0.65 ± 0.34 |
| Collagen Type 1 | 1.00 ± 0.22 | 0.88 ± 0.24 | 0.89 ± 0.34 | 1.00 ± 0.29 | 0.69 ± 0.20 |
| TGF-β | 1.00 ± 0.24 | 1.07 ± 0.60 | 0.90 ± 0.26 | 1.00 ± 0.45 | 0.77 ± 0.22 |

As noted above, PEG-Compound 1 reduced hepatic fat accumulation as assessed by a biochemical assay measuring hepatic triglyceride content and histology following staining of liver sections with hematoxylin and eosin or oil red 0. This anti-steatotic activity of native FGF21 has been reported in the literature to depend on adiponectin in the mouse (see Lin et al., Cell Metab. 17: 779-789 (2013); Holland et al., Cell Metab 17: 790-797 (2013), each of which is hereby incorporated by reference in its entirety). Therefore, concentrations of total adiponectin were measured in terminal serum samples prepared from the treated mice. Serum adiponectin was measured following the manufacturer's protocol using a commercially available ELISA kit (Alpco catalog number 47-ADPMS-E01).

Figure 61:
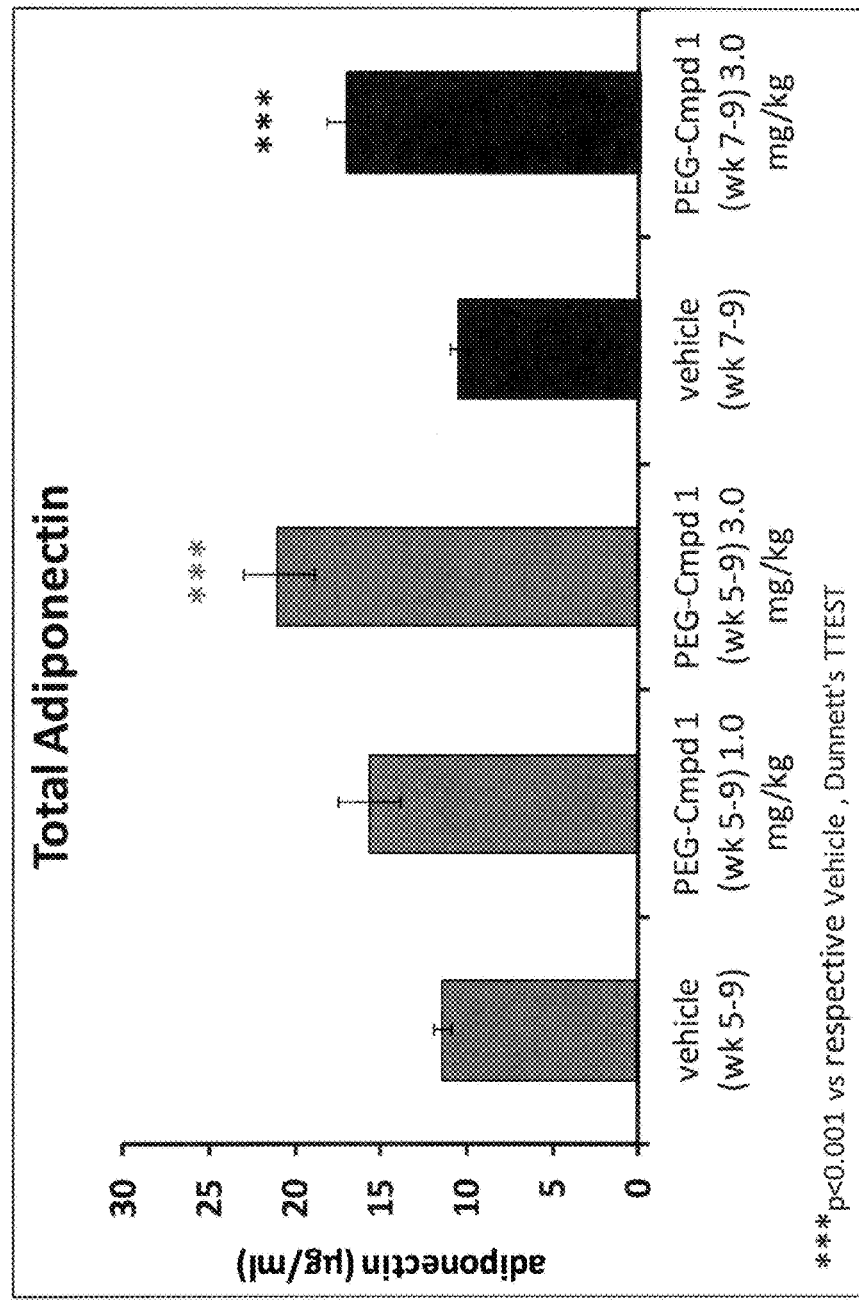
FIG. 61. Serum total adiponectin measurements in a Stelic NASH mouse study. Serum total adiponectin was significantly increased in mice treated with PEG-Compound 1 at 3.0 mg/kg, compared to vehicle-treated mice, in terminal plasma samples from mice treated between weeks 5-9 or weeks 7-9 (p<0.001, Dunnett's TTEST).

Twice weekly administration of 3 mg/kg PEG-Compound 1 statistically significantly increased serum total adiponectin, as compared to the corresponding vehicle group, at all terminal time-points tested (FIG. 61). This result is consistent with the hypothesis that adiponectin contributes to the efficacy of PEG-Compound 1 in the Stelic NASH model.

In conclusion, PEG-Compound 1 showed anti-NASH, anti-fibrotic effects associated with improved lipid and glucose metabolism in the present study.

Example 14

Solubility Assessment of Modified FGF-21 Polypeptides Comprising a Fusion Partner This example describes measurement of the relative solubility of modified FGF-21 polypeptides comprising a fusion partner. The results are indicative of the ability of a compound to be formulated to a relatively higher concentration, which would permit more facile administration of an effective dosage.

Methods

Relative solubility assessments were performed by sequential plug-flow concentration cycles followed by size-exclusion chromatography analysis. Samples, formulated in 20 mM Histidine buffer pH 7.0 at similar but not identical starting concentrations, were pipetted into 3 kDa molecular weight cut-off centrifuge concentrators and spun at 4,750 RPM for 15 minute, 15 minute, and 40 minute cycles at 4° C. In between spin cycles, aliquots were removed from the concentration apparatus and analytical size exclusion chromatography analysis (aSEC) was performed (on a GE Healthcare Superdex S-75 10/300 GL column equilibrated in PBS pH 7.2 buffer) to determine the concentration of HMW and monomer species in the solution.

Total Concentrations were determined by absorbance at 280 nm with a NanoDrop spectrophotometer. High molecular weight percentage was determined by area under the curve calculations of high molecular weight peaks relative to the monomer peaks in the SEC chromatogram trace. The resulting data points are plotted to visualize the rank order of least soluble constructs to most soluble under the conditions tested, the lower the slope created by the data points the more stable the protein variant under the conditions tested Results Relative solubility of Modified FGF-21 polypeptides comprising a fusion partner was determined by measuring the formation of high molecular weight (HMW) aggregates as a function of protein concentration. Lower HMW aggregate formation at a given concentration is indicative of greater solubility, which would result in the ability to be formulated to a higher concentration.

Figure 41:
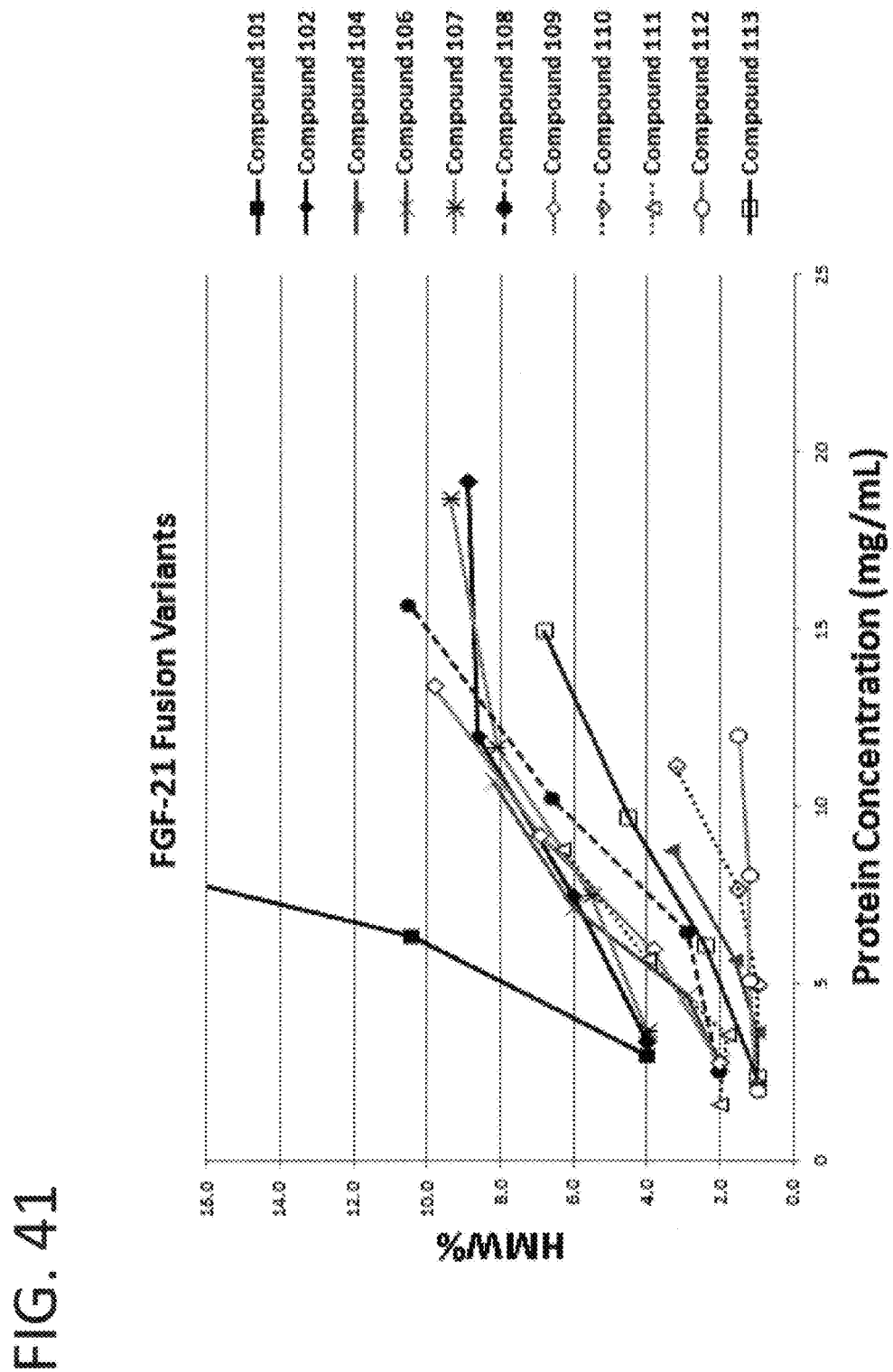
FIG. 41. Measurement of solubility for modified FGF-21 polypeptides fused to an adnectin fusion partner. Relatively lower formation of high molecular weight aggregates at a given polypeptide concentration is indicative of greater solubility, which would result in the ability to be formulated to a greater concentration. Observations of protein concentration vs. percent fraction of High Molecular Weight (HMW) species of tested compounds determined via the plug flow filtration assay in PBS buffer at pH 7.2. The linearized slope of the line fit to each of these observations was used as an estimate of protein aggregation propensity.

Results are shown graphically in FIG. 41. The slope of the plug flow solubility curve for the tested compounds is shown below in Table 16 (lower values indicate less aggregate formation and hence the ability to be formulated to a higher concentration).

TABLE 16

Plug Flow Solubility Results for modified FGF-21
Polypeptides comprising a fusion partner

| FGF21- PKE Adnectin(2) Fusion Compound | Plug Flow Solubility Slope |
|---|---|
| Compound 101 | 2.72 |
| Compound 102 | 0.31 |
| Compound 103 | n.d. |
| Compound 104 | 0.36 |
| Compound 105 | 0.88 |
| Compound 106 | 0.83 |
| Compound 107 | 0.37 |
| Compound 108 | 0.68 |
| Compound 109 | 0.76 |
| Compound 110 | 0.25 |
| Compound 111 | 0.65 |
| Compound 112 | 0.05 |
| Compound 113 | 0.47 |

Example 15

A Randomized, Double-Blind, Placebo-Controlled, Parallel Group, Multiple Dose Study to Evaluate the Safety, Pharmacokinetics and Pharmacodynamic Effects of PEG-Compound 1 in Adults with Non-alcoholic Steatohepatitis In the United States, NASH is one of the leading causes of cirrhosis in adults; up to 20% of adults with NASH develop cirrhosis. The histological findings of NASH include steatosis, inflammation and ballooning degeneration with varying amounts of pericellular fibrosis in liver, and occur in the absence of significant alcohol use. NASH patients exhibit increased mortality rates from cardiovascular-, liver- and cancer-related deaths. No specific medicinal treatment options are available.

This example describes a randomized, double-blind and placebo-controlled human clinical trial to evaluate the safety, pharmacokinetics and pharmacodynamic effects of PEG-Compound 1 (polypeptide of SEQ ID NO: 201, where pAF is linked to a 30 kDa PEG) in adults with NASH, including evaluation of safety, tolerability and change in hepatic fat fraction (%) by MRI.

Study Population: Approximately 90 male and female subjects aged 21 to 75 years are enrolled meeting all of the following criteria: a liver biopsy performed within 1 year of screening with documented results of NASH with NASH CRN fibrosis stage 1-3 or equivalent using a different scoring system; a BMI of ≥30 (weight (kg)/[height (m)]$^2$); a fatty liver index ≥60; a hepatic fat fraction (%) ≥10% by MRI performed during the screening period. Subjects undergo screening evaluations to determine eligibility within 42 days prior to randomization.

Subjects are excluded from the study if there is evidence of concurrent disease including chronic liver disease (other than NASH), cirrhosis, decompensated liver disease, uncontrolled diabetes, and certain other medical conditions or history.

Baseline scans are conducted approximately 14 to 35 days prior to the Day 1 dose of the active drug or placebo, including hepatic fat content by magnetic resonance imaging (MRI), liver stiffness by magnetic resonance elastography (MRE), and body composition by dual-energy X-ray absorptiometry (DXA). Additional baseline patient evaluation includes determining weight, BMI, and waist circumference.

Treatment Regimen: PEG-Compound 1 is administered daily or weekly for 16 weeks to adults with NASH. Treatment is self-administered subcutaneously subsequent to 7-day patient training in proper use of the injector with placebo. Approximately 90 eligible subjects are randomized on Day 1 to one of three treatment groups (30 per group), who are then treated (starting from Day 1) as follows: Treatment A: 10 mg PEG-Compound 1 daily; Treatment B: 20 mg PEG-Compound 1 weekly; Treatment C: Placebo daily. Subjects are stratified using diagnosis of Type 2 diabetes mellitus (yes vs no) based on current American Diabetes Association criteria.

All subjects self-administer PEG-Compound 1 or placebo once daily. PEG-Compound 1 is provided in 10 mg/mL solution. For the Treatment B (20 mg/wk) group, 2 injections of 1 mL each are given concurrently on Day 1 (D 1) and on Days 2-7, the injection is placebo. To maintain blind the other two groups also have two Day 1 injections, one or both of which contain a placebo. On Days 2-7, the injection is 1 mL of PEG-Compound 1 (Treatment A group) or 1 mL placebo (Treatment C group). Treatment continues until day 112 (D 112) (i.e., 16 weeks).

Patient Evaluation: Patient evaluation is conducted at D-7 (the start of the placebo-only lead-in), D 1, D 15, D 29, D 43, D 57, D 86, and D 112. Physical examinations, vital sign measurements, 12-lead electrocardiograms (ECG), clinical laboratory evaluations, and MRI, MRE and DXA scans are performed. The MRI, MRE and DXA end-of-treatment scans are conducted at Day 112 (+/−1 week). Follow-up visits are conducted at around D 142 and D 292, with the DXA follow-up scanning conducted 6 months (+/−2 weeks) after the last dose. Blood is collected for pharmacokinetic (PK) and pharmacodynamic (PD) analysis. Serum concentration of PEG-Compound 1 (Total and C-terminal intact) are measured by a validated assay. All PK data collected in the study are assessed by a developed population PK model to estimate model-based parameters such as CL/F, Vc/F, Ka etc. Furthermore, estimates of individual exposure parameters (such as Cavg, Cmin, Cmax and AUC at steady state) are derived from the model-based parameters. Subjects are closely monitored for adverse events throughout the study.

Primary Endpoints: The primary objective is to assess the effect of daily or weekly doses of PEG-Compound 1 on safety, tolerability and hepatic fat fraction (%) by MRI in patients with biopsy proven NASH. This will be assessed by the primary endpoint of change in percent hepatic fat fraction (%) from baseline to Week 16, determined by proton density fat-fraction hepatic MRI. Baseline is defined as the last non-missing pre-dose measurement for all the endpoints. PEG-Compound 1 administered daily or weekly for 16 weeks to patients with NASH is predicted to lower hepatic fat fraction (%) to a greater extent than placebo. Primary endpoints also include safety endpoints including incidence of AEs, serious AEs, and events of special interest including injection site assessment, AEs leading to discontinuation, and death as well as marked abnormalities in clinical laboratory tests, vital sign measurements, ECGs, physical examinations and bone mineral density (BMD) collected by DXA scan at specified time points.

Secondary Endpoints: Secondary endpoints include pharmacokinetic endpoints and immunogenicity endpoints. The pharmacokinetic endpoints will be assessed by model-based pharmacokinetic parameters of PEG-Compound 1 (Total and C-Terminal intact) serum concentration: Cavg, Cmin, Cmax and AUC(TAU) determined from measurements conducted at selected time points. Immunogenicity endpoints are assessed by patient levels of anti-PEG-Compound 1 antibodies and anti-FGF21 antibodies. Model-based pharmacokinetic parameters of PEG-Compound 1 (Total and C-Terminal intact) serum concentration are determined Primary PK parameters include: CL/F (apparent clearance after extra-venous administration); V/F (Apparent volume of distribution after extra-venous administration); and Ka (rate constant of absorption from injection site into blood circulation). From the primary PK parameters, secondary PK parameters are derived, including Cmax (maximum calculated serum concentration); T½ (elimination half-life); AUC (TAU) (area under the concentration-time curve in one dosing interval); Cmin (minimal concentration within dosing interval); and Cavg (average concentration within dosing interval).

Analysis: A longitudinal repeated measures analysis is used to analyze the change in hepatic fat fraction (%) at Week 16 from baseline in the treated population who have both a baseline and at least one post-baseline measurement. The model includes treatment group, week and treatment-by-week interactions as main effects and baseline hepatic fat fraction (%) and baseline diabetic status as covariates. An unstructured covariance matrix is used to represent the correlation of the repeated measures within each subject. The model provides point estimates, standard errors and 2-sided 90% confidence intervals for mean change from baseline within and between treatments. P-values are calculated to compare the treatment effect in each of two PEG-Compound 1 treatment groups (10 mg daily and 20 mg weekly) to that in the placebo treatment group at Week 16. Each treatment group comparison is performed at a one-sided 0.05 significance level. No adjustments are made for multiplicity.

The relationship between PEG-Compound 1 (total and C-terminal intact) exposure and other biomarkers or endpoints are explored to show dose-response relationships. These measurements are also analyzed to show their relationship to the change in hepatic fat fraction and how these biomarkers predict or relate to that change. These endpoints and biomarkers include changes in liver stiffness by MRE, body weight, BMI, waist circumference, body composition by DXA, Glucose homeostasis, insulin sensitivity, fasting lipids, bone homeostasis, ALT and AST, as well as biomarkers associated with the risk of disease progression and complications. NASH is typically associated with reduced levels of adiponectin (hypoadiponectinemia), and reduced levels are associated with more extensive necroinflammation. Adiponectin is believed to increase insulin sensitivity by enhancing fat oxidation and reducing hepatic lipid storage. Serum total adiponectin levels are expected to be increased by PEG-Compound 1 treatment. PEG-Compound 1 treatment is also expected to reduce fasting triglyceride, LDL, ApoB, ApoC3 and increase HDL in NASH patients.

Analysis of the study results, using an unstructured covariance matrix as described above, is conducted to show a statistically significant (p<0.05) reduction in hepatic fat fraction in patients treated with PEG-Compound 1 (in both the daily and weekly administration study groups) compared to placebo controls.

Example 16

This example further explores the efficacy of PEG-Compound 1 in the STAM model of Non-alcoholic Steatohepatitis (NASH). Mice were treated between 9 and 12 weeks of age or to 15 weeks of age.

Methods

PEG-Compound 1 and Vehicle (20 mM Tris/250 mM sucrose, pH 8.3) were provided. To prepare dosing solution, PEG-Compound 1 solution was prepared by appropriate dilution with the provided vehicle.

C57BL/6 mice (15-day-pregnant female) were obtained from Japan SLC, Inc. (Shizuoka, Japan). All animals used in the study were housed and cared for in accordance with the Japanese Pharmacological Society Guidelines for Animal Use. NASH was induced in 60 male mice by a single subcutaneous injection of 200 μg streptozotocin (STZ, Sigma-Aldrich, USA) solution 2 days after birth and feeding with high fat diet (HFD, 57 kcal % fat, cat #: HFD32, CLEA Japan, Inc., Japan) after 4 weeks of age.

PEG-Compound 1 and Vehicle were administered by subcutaneously route in a volume of 1 mL/kg at a dose of 3 mg/kg twice per week. The animals were maintained in a SPF facility under controlled conditions of temperature (23±2° C.), humidity (45±10%), lighting (12-hour artificial light and dark cycles; light from 8:00 to 20:00) and air exchange. A high pressure (20±4 Pa) was maintained in the experimental room to prevent contamination of the facility. The animals were housed in polycarbonate cages KN-600 (Natsume Seisakusho, Japan) with a maximum of 4 mice per cage. Sterilized Paper-Clean (Japan SLC) was used for bedding and replaced once a week. Sterilized solid HFD was provided ad libitum, being placed in the metal lid on top of the cage. Pure water was provided ad libitum from a water bottle equipped with a rubber stopper and a sipper tube. Water bottles were replaced once a week, cleaned and sterilized in autoclave and reused. Mice were identified by numbers engraved on earrings. Each cage was labeled with a specific identification code.

Non-fasting blood glucose was measured in whole blood using LIFE CHECK (EIDIA Co. Ltd., Japan). For plasma biochemistry, blood was collected in polypropylene tubes with anticoagulant (Novo-Heparin, Mochida Pharmaceutical Co. Ltd., Japan) and centrifuged at 1,000×g for 15 minutes at 4° C. The supernatant was collected and stored at −80° C. until use. Plasma ALT, triglyceride and total cholesterol levels were measured by FUJI DRI-CHEM 7000 (Fujifilm Corporation, Japan).

Liver total lipid-extracts were obtained by Folch's method (Folch J. et al., J. Biol. Chem. 1957; 226: 497). Liver samples were homogenized in chloroform-methanol (2:1, v/v) and incubated overnight at room temperature. After washing with chloroform-methanol-water (8:4:3, v/v/v), the extracts were evaporated to dryness, and dissolved in isopropanol. Liver triglyceride and cholesterol contents were measured by Triglyceride E-test and Cholesterol E-test, respectively (Wako Pure Chemical Industries, Ltd., Japan).

For HE staining, sections were cut from paraffin blocks of liver tissue prefixed in Bouin's solution and stained with Lillie-Mayer's Hematoxylin (Muto Pure Chemicals Co., Ltd., Japan) and eosin solution (Wako Pure Chemical Industries). NAFLD Activity score (NAS) was calculated according to the criteria of Kleiner (Kleiner D E. et al., Hepatology, 2005; 41:1313). To visualize collagen deposition, Bouin's fixed liver sections were stained using picro-Sirius red solution (Waldeck, Germany). To visualize macro- and microvesicular fat, cryosections were cut from frozen liver tissues, prefixed in 10% neutral buffered formalin, embedded in Tissue-Tek O.C.T. compound (Sakura Finetek Japan Co. Ltd., Japan), and stained with Oil Red 0 (Sigma-Aldrich). For immunohistochemistry, sections were cut from frozen liver tissues embedded in Tissue-Tek O.C.T. compound and fixed in acetone. Endogenous peroxidase activity was blocked using 0.03% H2O2 for 5 minutes, followed by incubation with Block Ace (Dainippon Sumitomo Pharma Co. Ltd., Japan) for 10 minutes. The sections were incubated with a 200-fold dilution of anti-F4/80 antibody (BMA Biomedicals, Switzerland) over night at 4° C. After incubation with secondary antibody (HRP-Goat anti-rat antibody, Invitrogen, USA), enzyme-substrate reactions were performed using 3,3'-diaminobenzidine/H2O2 solution (Nichirei Bioscience Inc., Japan).

The kidney was fixed in Bouin's solution. The glomerular architecture was observed using PAS staining with sections oxidized by 0.5% periodic acid and stained with Schiff's reagent (both from Wako Pure Chemical Industries). To visualize collagen deposition, kidney sections were stained with picro-Sirius red solution (Waldeck).

For quantitative analysis of fibrosis, fat deposition and inflammation areas bright field images of Sirius red-stained, oil red-stained and F4/80-immunostained sections were captured around the central vein for livers or interstitial region for kidneys using a digital camera (DFC280; Leica, Germany) at 200-fold magnification, and the positive areas in 5 fields/section were measured using ImageJ software (National Institute of Health, USA).

Statistical analyses were performed using Bonferroni Multiple Comparison Test on GraphPad Prism 4 (GraphPad Software Inc., USA). P values <0.05 were considered statistically significant. A trend or tendency was assumed when a one-tailed t-test returned P values <0.05. Results were expressed as mean±SD.

Results

Study Groups were as follows (summarized in Table 17 below).

Group 1: Vehicle. Twenty NASH mice were subcutaneously administered vehicle in a volume of 1 mL/kg twice per week from 9 to 12 weeks of age or to 15 weeks of age.

Group 2: PEG-Compound 1. Twenty NASH mice were subcutaneously administered vehicle supplemented with PEG-Compound 1 at a dose of 3 mg/kg twice per week from 9 to 12 weeks of age or to 15 weeks of age.

TABLE 17

Treatment summary.

| Group | No. mice | Mice | Test substance | Dose (mg/kg) | Volume (mL/kg) | Regimens | Sacrifice (wks) |
|---|---|---|---|---|---|---|---|
| 1 | 20 | STAM | Vehicle | — | 1 | SC, twice per weeks, 9 wks-12 wks or 15 wks | 12, 15 |
| 2 | 20 | STAM | PEG-Compound 1 | 3 | 1 | SC, twice per weeks, 9 wks-12 wks or 15 wks | 12, 15 |

The viability, clinical signs and behavior were monitored daily. Body weight was recorded before the treatment. Mice were observed for significant clinical signs of toxicity, moribundity and mortality approximately 60 minutes after each administration. The animals were sacrificed by exsanguination through direct cardiac puncture under ether anesthesia (Wako Pure Chemical Industries). Six animals in all groups were sacrificed at 12 weeks of age for the following assays, and the remaining animals were kept until the day of sacrifice at 15 weeks of age.

Body weight in the all groups did not obviously change during the treatment period. There were no significant differences in mean body weight between the Vehicle group and the PEG-Compound 1 group.

During the treatment period, mice died before reaching day 40 as follows: eight out of 20 mice died in the Vehicle group. No animals were found dead in the PEG-Compound 1 group. The cause of the death remained unclear and could be disease progression related in the Vehicle group. The days of death of the individual mice were days 7, 17 (two mice), 20 (two mice), 34, 38, and 40. After 5 mice died in the Vehicle group, the decision was made to modify the original study protocol and reduce the number of mice sacrificed at week 12 from 8 to 6 per group in an attempt to ensure that at least 6 mice in each group would survive to week 15.

In the animals treated between weeks 9-12, there were no significant differences in the mean body weight on the day of sacrifice between the Vehicle group and the PEG-Compound 1 group (FIG. 42A). Likewise, in the animals treated between weeks 9-15, there were no significant differences in the mean body weight on the day of sacrifice between the Vehicle group and the PEG-Compound 1 group (FIG. 42B).

Organ weight and liver-to-body weight ratio are shown in FIGS. 43-46 and summarized in Table 18.

Figure 46A:
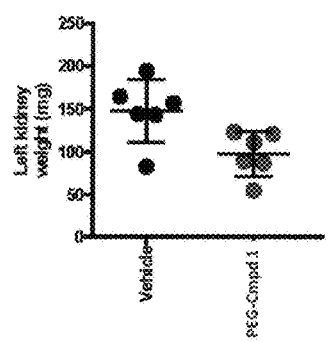
FIG. 46A-B. Left kidney weight of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15.
Figure 46B:
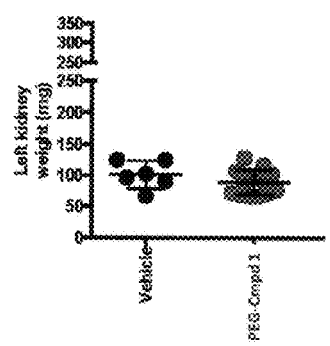

In the animals treated between weeks 9-12, the PEG-Compound 1 group showed decreasing tendencies in mean liver weight compared with the Vehicle group (FIG. 43A). The mean liver-to-body weight ratio significantly decreased in the PEG-Compound 1 group compared with the Vehicle group (p<0.01) (FIG. 44A). There were no significant differences in the mean right kidney weight between the Vehicle group and the PEG-Compound 1 group (FIG. 45A). Mean left kidney weight tended to decrease in the PEG-Compound 1 group compared with the Vehicle group (FIG. 46A).

In the animals treated between weeks 9-15, the PEG-Compound 1 group significantly decreased mean liver weight (p<0.001) (FIG. 43B) and mean liver-to-body weight ratio (p<0.001) (FIG. 44B) compared with the Vehicle group. There were no significant differences in the mean right kidney weight (FIG. 45B) and mean left kidney weight (FIG. 46B) between the Vehicle group and the PEG-Compound 1 group.

TABLE 18

Body weight and organ weight results.

| | Parameter (mean ± SD) | |
| --- | --- | --- |
| | 12 wks Vehicle (n = 6) | 12 wks PEG-Compound 1 (n = 6) |
| Body weight (g) | 18.0 ± 4.7 | 16.0 ± 3.9 |
| Liver weight (mg) | 1389 ± 374 | 973 ± 226 |
| Liver-to-body weight ratio (%) | 7.7 ± 1.1 | 6.1 ± 0.7 |
| Right kidney weight (mg) | 143 ± 40 | 110 ± 25 |
| Left kidney weight (mg) | 148 ± 37 | 98 ± 26 |
| | Parameter (mean ± SD) | |
| | 15 wks Vehicle (n = 6) | 15 wks PEG-Compound 1 (n = 14) |
| Body weight (g) | 16.5 ± 4.8 | 15.2 ± 2.5 |
| Liver weight (mg) | 1341 ± 374 | 746 ± 161 |
| Liver-to-body weight ratio (%) | 8.2 ± 1.5 | 5.0 ± 1.1 |
| Right kidney weight (mg) | 111 ± 26 | 97 ± 24 |
| Left kidney weight (mg) | 101 ± 22 | 90 ± 20 |

Biochemical measurement results are shown in FIGS. 47-52 and summarized in Table 19, below.

In the animals treated between weeks 9-12, there were no significant differences in whole blood glucose levels between the Vehicle group and the PEG-Compound 1 group (FIG. 47A).

In the animals treated between weeks 9-15, whole blood glucose levels in the PEG-Compound 1 group significantly decreased compared with the Vehicle group (p<0.05) (FIG. 47B).

In the animals treated between weeks 9-12, there was no significant difference in plasma ALT levels between the Vehicle group and the PEG-Compound 1 group (FIG. 48A).

In the animals treated between weeks 9-15, plasma ALT levels in the PEG-Compound 1 group significantly decreased compared with the Vehicle group (p<0.01) (FIG. 48B).

Figure 49A:
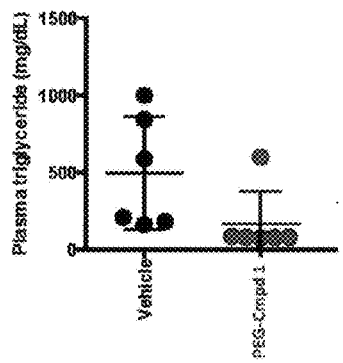
FIG. 49A-B. Plasma triglyceride of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15.

In the animals treated between weeks 9-12, the PEG-Compound 1 group showed a tendency to decrease in plasma triglyceride levels compared with the Vehicle group (FIG. 49A).

Figure 49B:
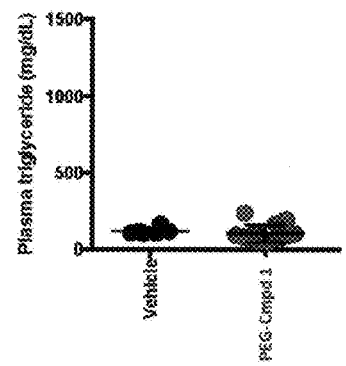

In the animals treated between weeks 9-15, there was no significant difference in plasma triglyceride levels between the Vehicle group and the PEG-Compound 1 group (FIG. 49B).

Figure 50A:
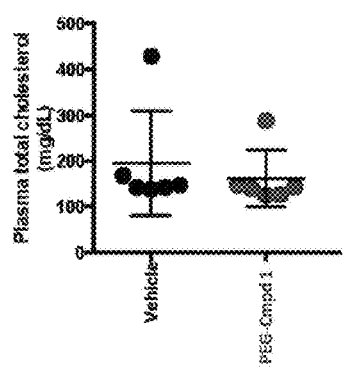
FIG. 50A-B. Plasma total cholesterol of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15.

In the animals treated between weeks 9-12, there were no significant differences in plasma total cholesterol between the Vehicle group and the PEG-Compound 1 group (FIG. 50A).

Figure 50B:
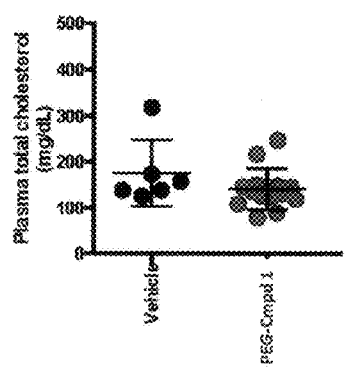

In the animals treated between weeks 9-15, there were no significant differences in plasma total cholesterol between the Vehicle group and the PEG-Compound 1 group (FIG. 50B).

In the animals treated between weeks 9-12, liver triglyceride contents in the PEG-Compound 1 group significantly decreased compared with the Vehicle group (p<0.01) (FIG. 51A).

In the animals treated between weeks 9-15, liver triglyceride contents in the PEG-Compound 1 group significantly decreased compared with the Vehicle group (p<0.001) (FIG. 51B).

In the animals treated between weeks 9-12, liver cholesterol contents in the PEG-Compound 1 group significantly decreased compared with the Vehicle group (p<0.01) (FIG. 52A).

In the animals treated between weeks 9-15, liver cholesterol contents in the PEG-Compound 1 group significantly decreased compared with the Vehicle group (p<0.001) (FIG. 52B).

TABLE 19

Biochemical test results.

| | Parameter (mean ± SD) | |
| --- | --- | --- |
| | 12 wks Vehicle (n = 6) | 12 wks PEG-Compound 1 (n = 6) |
| Whole blood glucose (mg/dL) | 628 ± 268 | 505 ± 231 |
| Plasma ALT (U/L) | 55 ± 30 | 39 ± 21 |
| Plasma triglyceride (mg/dL) | 498 ± 368 | 167 ± 214 |
| Plasma total cholesterol (mg/dL) | 195 ± 115 | 162 ± 62 |
| Liver triglyceride (mg/g liver) | 98 ± 38 | 42 ± 13 |
| Liver cholesterol (mg/g liver) | 36 ± 15 | 18 ± 4 |
| | Parameter (mean ± SD) | |
| | 15 wks Vehicle (n = 6) | 15 wks PEG-Compound 1 (n = 14) |
| Whole blood glucose (mg/dL) | 594 ± 182 | 350 ± 174 |
| Plasma ALT (U/L) | 48 ± 15 | 23 ± 15 |
| Plasma triglyceride (mg/dL) | 117 ± 24 | 102 ± 57 |
| Plasma total cholesterol (mg/dL) | 176 ± 72 | 141 ± 45 |
| Liver triglyceride (mg/g liver) | 98 ± 31 | 49 ± 19 |
| Liver cholesterol (mg/g liver) | 39 ± 10 | 19 ± 9 |

Representative micrographs showing histological analysis of liver samples are shown in FIGS. 53, 55, 57, and 59. Summaries of histological results are shown graphically in FIGS. 54, 56, 58, and 60, and are tabulated in Table 22, below.

Figure 53A:
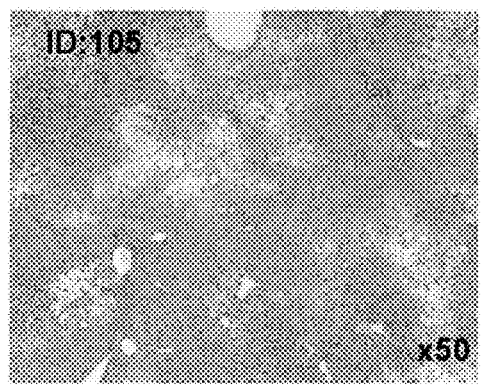
FIG. 53A-H. Representative photomicrographs of HE-stained liver sections of mice treated for weeks 9-12 with vehicle (A-B) or PEG-Compound 1 (C-D), and for weeks 9-15 with vehicle (E-F) or PEG-Compound 1 (G-H).
Figure 53B:
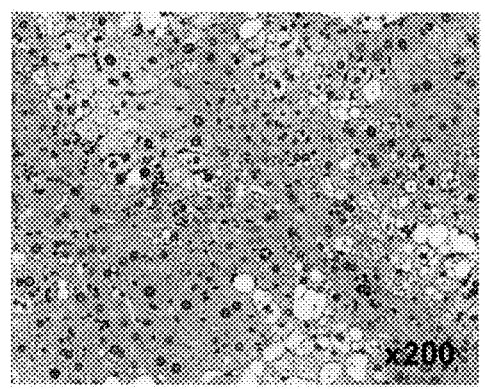
Figure 53C:
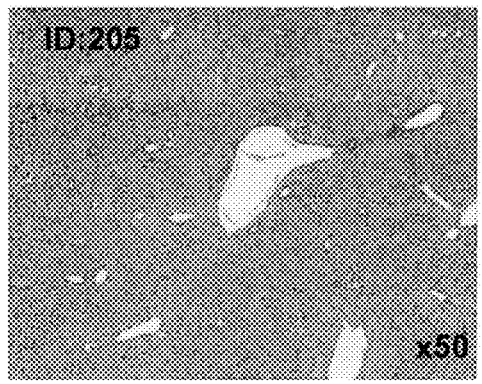
Figure 53D:
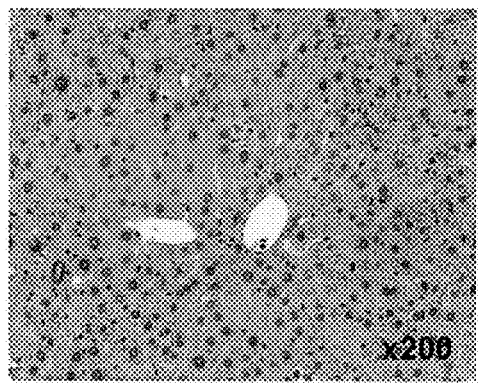
Figure 53E:
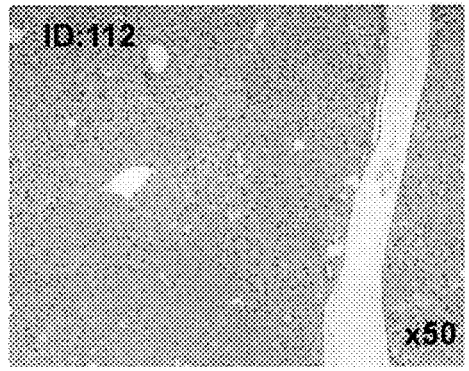
Figure 53F:
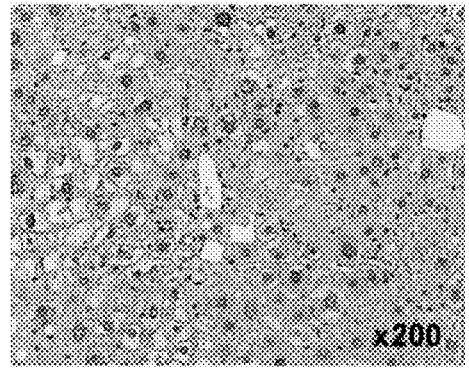

In the animals treated between weeks 9-12, HE stained liver sections from the Vehicle group exhibited severe micro- and macrovesicular fat deposition, hepatocellular ballooning and inflammatory cell infiltration (FIG. 53A-B). The PEG-Compound 1 group showed marked improvements in fat deposition, hepatocellular ballooning and inflammatory cell infiltration, with significant reduction in NAS compared with the Vehicle group (FIG. 53C-D).

Figure 53G:
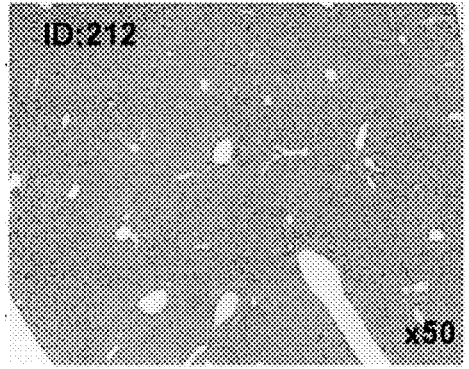
Figure 53H:
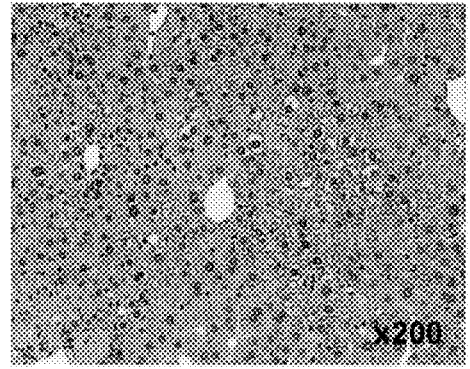
Figure 55E:
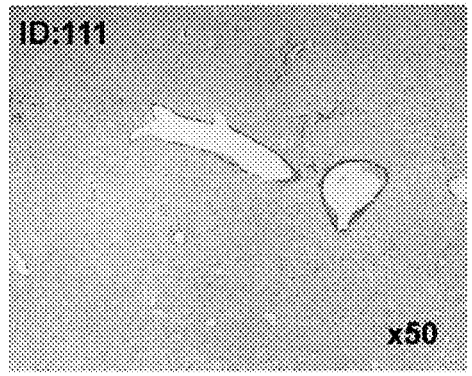
Figure 55F:
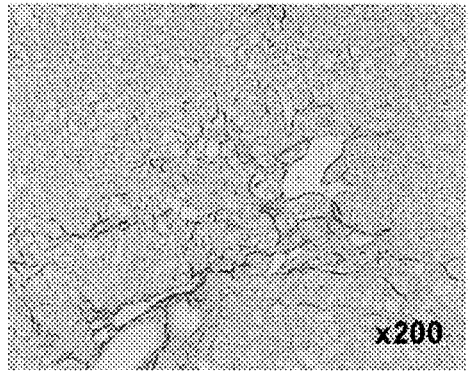
Figure 55G:
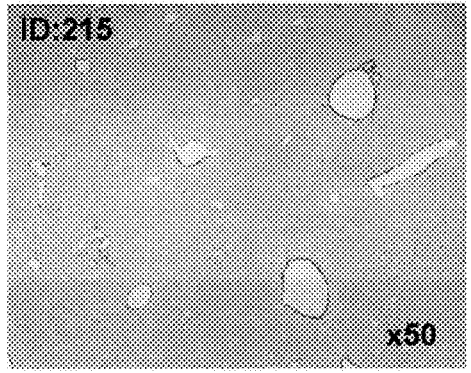
Figure 55H:
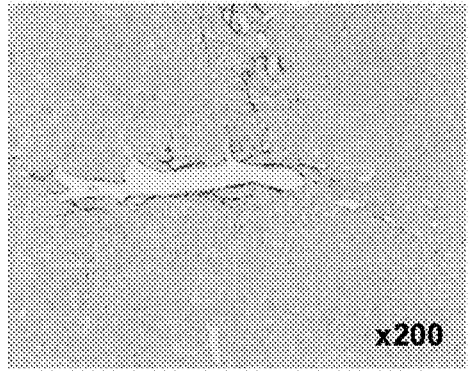

In the animals treated between weeks 9-15, the PEG-Compound 1 group showed marked improvements in fat deposition, hepatocellular ballooning and inflammatory cell infiltration (FIG. 53E-F), with significant reduction in NAS compared with the Vehicle group (FIG. 53G-H).

NALFD activity score results are shown graphically in FIG. 54A-B for animals treated between weeks 9-12 and 9-13, respectively, and are summarized in Table 20. NALFD activity score was significantly decreased in both treatment groups ($p<0.01$ and $p<0.001$ for animals treated between 9-12 and 9-15 weeks, respectively).

TABLE 20

Summary of NALFD activity score results.
Score components are as shown in Table 21, below.

| Group | N | Steatosis 0 | 1 | 2 | 3 | Lobular Inflammation 0 | 1 | 2 | 3 | Hepatocyte ballooning 0 | 1 | 2 | NAS (mean ± SD) |
|---|---|---|---|---|---|---|---|---|---|---|---|---|---|
| 12 wks Vehicle | 6 | 1 | 4 | — | 1 | — | 2 | 4 | — | — | — | 6 | 4.8 ± 1.2 |
| 12 wks PEG-Compound 1 | 6 | 6 | — | — | — | 1 | 2 | 2 | 1 | 2 | 4 | — | 2.2 ± 0.8 |
| 15 wks Vehicle | 6 | 1 | 3 | 1 | 1 | — | 1 | 5 | — | — | — | 6 | 5.2 ± 1.2 |
| 15 wks PEG-Compound 1 | 14 | 11 | 3 | — | — | 6 | 6 | 2 | — | 7 | 5 | 2 | 1.6 ± 1.2 |

TABLE 21

NALFD activity score components.

| Item | Score | Extent |
|---|---|---|
| Steatosis | 0 | <5% |
|  | 1 | 5-33% |
|  | 2 | >33-66% |
|  | 3 | >66% |
| Hepatocyte Ballooning | 0 | None |
|  | 1 | Few balloon cells |
|  | 2 | Many cells/prominent ballooning |
| Lobular Inflammation | 0 | No foci |
|  | 1 | <2 foci/200x |
|  | 2 | 2-4 foci/200x |
|  | 3 | >4 foci/200x |

In the animals treated between weeks 9-12, sirius red stained liver sections from the Vehicle group exhibited collagen deposition in the pericentral region of liver lobule (FIG. 55A-B). There were no significant differences in the fibrosis area between the Vehicle group and the PEG-Compound 1 group (FIG. 55C-D), as summarized in FIG. 56A.

In the animals treated between weeks 9-15, the fibrosis area significantly decreased in the PEG-Compound 1 group (FIG. 55E-F) compared with Vehicle group (FIG. 55G-H), as summarized in FIG. 56B ($p<0.05$).

Representative photomicrographs of the F4/80-immunostained sections are shown in FIG. 57.

In the animals treated between weeks 9-12, F4/80 immunostaining of liver sections form the Vehicle group demonstrated accumulation of F4/80+ cells in the liver lobule (FIG. 57A-B). There were no significant differences in the number and size of F4/80+ cells between the Vehicle group and the PEG-Compound 1 group (FIG. 57C-D), as summarized in FIG. 58A.

Figure 58A:
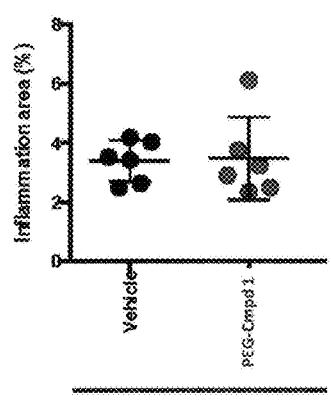
FIG. 58A-B. Summary of inflammation area of treatment groups in a Stelic NASH mouse study. A. Comparison of mice treated with vehicle or PEG-Compound 1 for weeks 9-12. B. Comparison of mice treated with vehicle or PEG-Compound 1 for weeks 9-15.
Figure 58B:
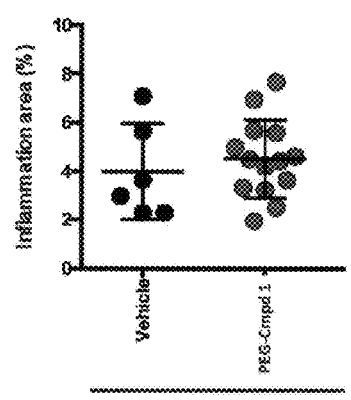

In the animals treated between weeks 9-15, there were no significant differences in the number and size of F4/80+ cells between the Vehicle group (FIG. 57E-F) and the PEG-Compound 1 group (FIG. 57G-H), as summarized in FIG. 58B.

Figure 59E:
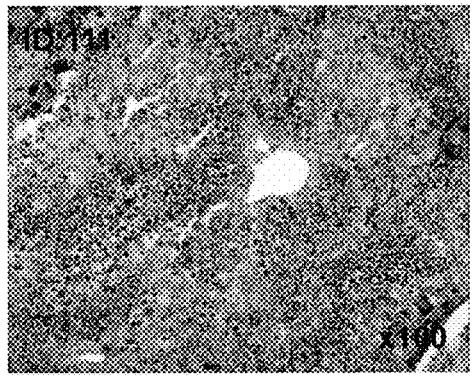
Figure 59F:
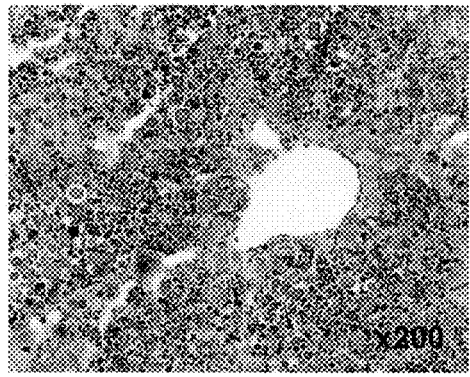
Figure 59G:
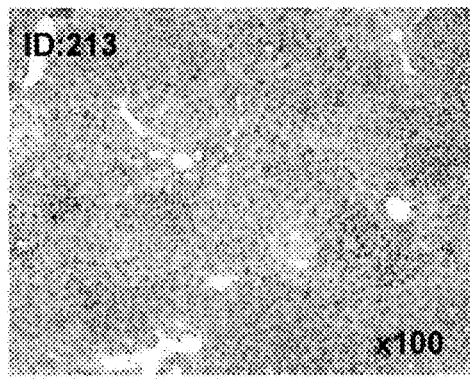
Figure 59H:
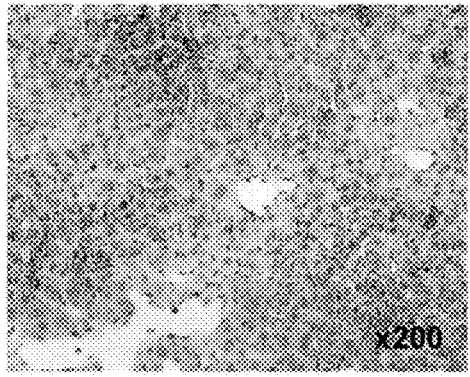

Representative photomicrographs of the oil red-stained sections are shown in FIG. 59A-H In the animals treated between weeks 9-12, oil red-stained liver sections from the Vehicle group exhibited micro- and macrovesicular fat deposition in the hepatocytes (FIG. 59A-B). The percentage of fat deposition area (oil red-positive area) significantly decreased in the PEG-Compound 1 group (FIG. 59C-D) compared with the Vehicle group, as summarized in FIG. 60A ($p<0.001$).

In the animals treated between weeks 9-15, the percentage of fat deposition area significantly decreased in the PEG-Compound 1 group (FIG. 59E-F) compared with the Vehicle group (FIG. 59G-H), as summarized in FIG. 60B ($p<0.001$).

TABLE 22

Summary of Histological Findings

| | Parameter (mean ± SD) | |
|---|---|---|
| | 12 wks Vehicle (n = 6) | 12 wks PEG-Compound 1 (n = 6) |
| Liver fibrosis area (%) | 1.17 ± 0.33 | 0.97 ± 0.51 |
| Inflammation area (%) | 3.38 ± 0.70 | 3.47 ± 1.40 |
| Fat deposition area (%) | 40.1 ± 4.8 | 16.2 ± 7.9 |
| Kidney fibrosis area (%) | 1.70 ± 0.49 | 1.67 ± 0.92 |
| | Parameter (mean ± SD) | |
| | 15 wks Vehicle (n = 6) | 15 wks PEG-Compound 1 (n = 14) |
| Liver fibrosis area (%) | 2.18 ± 0.14 | 1.44 ± 0.53 |
| Inflammation area (%) | 3.983 ± 1.966 | 4.511 ± 1.597 |
| Fat deposition area (%) | 32.0 ± 9.6 | 12.5 ± 10.1 |
| Kidney fibrosis area (%) | 1.58 ± 0.41 | 1.77 ± 0.69 |

As noted above, PEG-Compound 1 reduced hepatic fat accumulation as assessed by a biochemical assay measuring hepatic triglyceride content and histology following staining of liver sections with hematoxylin and eosin or oil red O. This anti-steatotic activity of native FGF21 has been reported in the literature to depend on adiponectin in the mouse (see Lin et al., Cell Metab. 17: 779-789 (2013); Holland et al., Cell Metab 17: 790-797 (2013), each of which is hereby incorporated by reference in its entirety). Therefore, concentrations of total adiponectin were measured in terminal serum samples prepared from the treated mice. Serum adiponectin was measured following the manufacturer's protocol using a commercially available ELISA kit (Alpco catalog number 47-ADPMS-E01).

Figure 62:
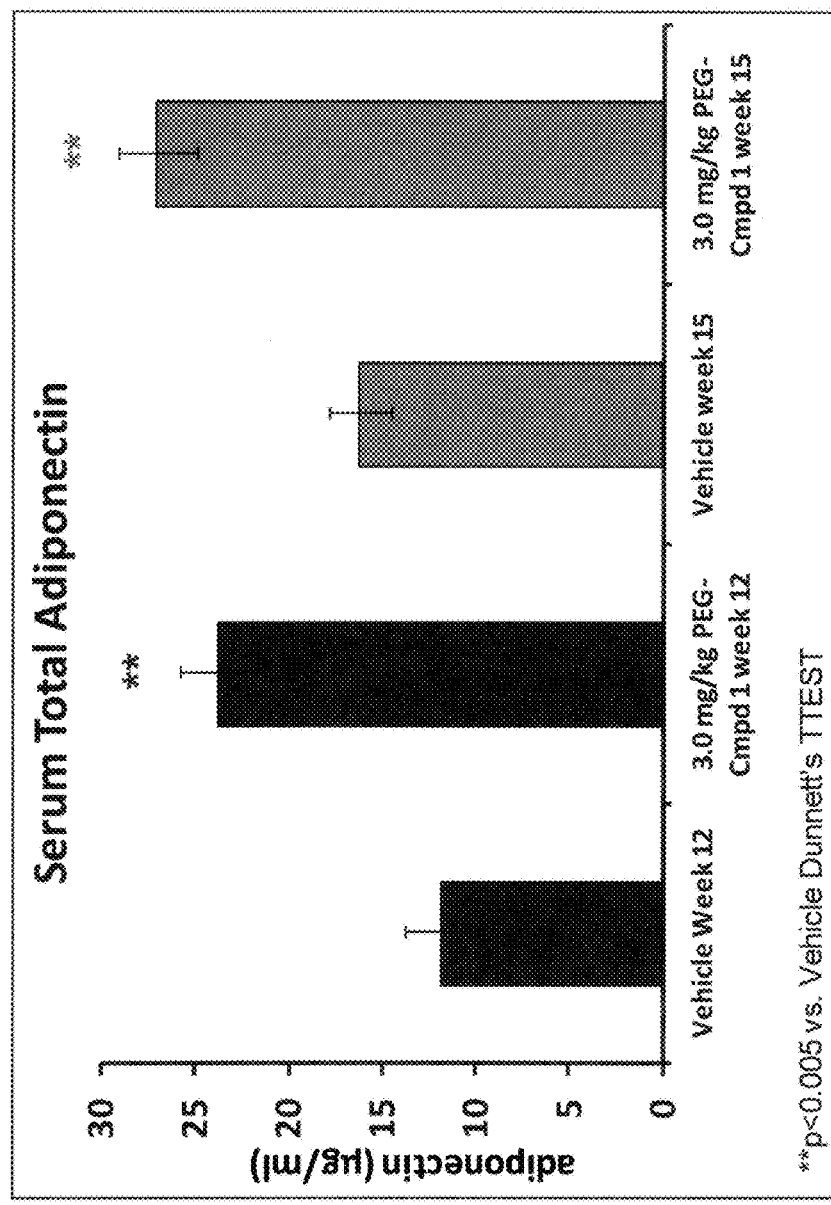
FIG. 62. Serum total adiponectin measurements in a Stelic NASH mouse study. Serum total adiponectin was significantly increased in mice treated with PEG-Compound 1 at 3.0 mg/kg, compared to vehicle-treated mice, in terminal plasma samples from mice at week 12 or 15 (p<0.05, Dunnett's TTEST).

Twice weekly administration of 3 mg/kg PEG-Compound 1 statistically significantly increased serum total adiponectin, as compared to the corresponding vehicle group, at all terminal time-points tested (FIG. 62). This result is consistent with the hypothesis that adiponectin contributes to the efficacy of PEG-Compound 1 in the Stelic NASH model.

In summary, treatment for three weeks with PEG-Compound 1 significantly reduced liver-to-body weight ratio, liver lipid content (triglyceride and cholesterol), fat deposition area and NAS. In addition to these effects, treatment for 6 week with PEG-Compound 1 significantly reduced the whole blood glucose, plasma ALT, and fibrosis area. Moreover, PEG-Compound 1 treatment improved survival rate compared with the Vehicle group.

In conclusion, PEG-Compound 1 showed anti-NASH, and anti-fibrotic effects including improved lipid and glucose metabolism.

Example 17

In Vitro Characterization of PEGylated Compound 2 in Human Embryonic Kidney Cells Stably Expressing Beta-Klotho FGF21 utilizes β-klotho as a co-receptor along with FGF receptors for its tissue-specific signaling activity (see, e.g., Kurosu et al., 2007, J. Biol. Chem. 282:26687-26695; Ogawa et al., 2007, Proc. Natl. Acad. of Sci., USA 104: 7432-7437, each of which is incorporated by reference in its entirety). FGF21 first binds to β-klotho and the complex can then activate FGF receptors to initiate an intracellular signaling cascade that rapidly activates extracellular signal-regulated kinases 1/2 (ERK1/2) over the course of minutes. Over longer times, activated, phosphorylated ERK (pERK) can translocate to the cell nucleus and phosphorylate and activate a number of transcriptional regulators including a ternary complex factor referred to as E Twenty-Six (ETS) like protein 1 (Elk1). Activated End forms a complex with serum response factor that binds to certain DNA sequences to regulate expression of certain genes.

Generation of a Cell Line Stably Co-Expressing Human β-Klotho and an Elk1-Luciferase Trans-Reporter Construct The Elk1-luciferase trans-reporting cell line was generated with HEK293 cells utilizing Agilent Technologies' PathDetect Elk1 trans-Reporting System. This system has a transactivator fusion plasmid that expresses a fusion protein of the DNA binding domain from the yeast transcriptional activator protein, Gal4, followed by the activation domain of Elk1. When the transcriptional activator, Elk1, is phosphorylated and activated by extracellular signal-regulated kinase (ERK) upon stimulation by FGF21, the fusion-activator protein binds as a dimer to the GAL4 upstream activation sequence and activates transcription of the luciferase reporter enzyme. Luciferase expression from the reporter plasmid indicates the activation of the fusion trans-activator protein and, therefore, the presence of the endogenous protein kinase. Accordingly, luciferase activity reflects the activation of ERK in the cell and the corresponding signal transduction pathways, in this case, activation of Elk1.

HEK293 cells were co-transfected with the fusion trans-activator plasmid, the reporter plasmid, and a plasmid encoding human β-klotho. The transfected cells were under the selection of G-418 (500 µg/ml) and blasticidin (10 µg/ml). The clones that survived dual antibiotic selection were analyzed by stimulating with an FGF21 construct and following Elk1-luciferase activity. HEK Luc Clone2 was selected as the cell line for all future assays.

Cell-Based Elk1-Luciferase Assay

The HEK293 Luc Clone2 cells were seeded in 96-well plates at a density of 25,000 cells per well. The plates were incubated in a tissue culture incubator at 37° C. with 5% $CO_2$ for two days. On the day of the assay, a 3-fold serial dilution series of the FGF21 proteins was prepared in phenol red-free DMEM media supplemented with 1×L-glutamine, 10 mM Hepes, pH 7.2-7.5, and 10% FBS. The old cell culture growth medium was removed. To start the treatment, 50 µl of phenol red-free DMEM medium with the testing compounds was added into each well and the plates were placed back into the cell culture incubator. At the end of 5 hours of incubation, an equal volume of luciferase substrate reagent mixture was added in each well. The plates were covered and placed on an orbital shaker for 3 min at 600 rpm. The luminescence was measured on Perkin Elmer's Envision 2103 Multiplate reader.

Data Analysis

Figure 63:
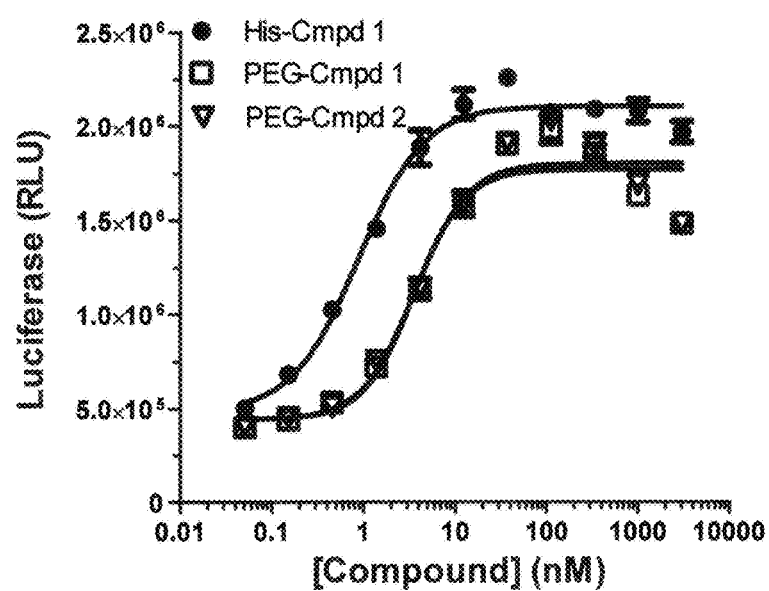
FIG. 63. Concentration-response curves for three FGF21 variants: N-terminally His-tagged Compound 1 (His-Cmpd 1), PEG-Compound 1 (PEG-Cmpd 1) and PEG-Compound 2 (PEG-Cmpd 2) in the 5 h Elk1-luciferase assay. Values are from 6 independent experiments with 3 or 4 replicates per experiment. Z' values varied between 0.6-0.9 indicating acceptable assay quality (Z'>0.5).

The raw data from all of the individual replicate data points were analyzed with GraphPad Prism 5 software (GraphPad Software Inc., CA) using a non-linear regression analysis. The data were fit using the log(agonist) against response equation with 4 parameters: Bottom (minimum), Top (maximum), log EC50 (measure of potency), and a variable Hill slope. The potency (EC50) was defined as the concentration that produced a half-maximal increase in the response above the baseline and was calculated by the curve-fitting program Results Representative concentration-response curves for three FGF21 variants (N-terminally His-tagged Compound 1 (His-Compound 1), PEG-Compound 1 and PEG-Compound 2) and the calculated potency and efficacy values in the 5 hours Elk1-luciferase assay are shown in FIG. 63 and Table 23. The potencies of the three variants were similar in the 5 hour Elk1-luciferase assay (Table 23).

TABLE 23

Potency And Efficacy of FGF21 Variants in the 5 hour Elk1-luciferase Assay

| | Potency | | Efficacy | |
|---|---|---|---|---|
| Compound | pEC50[a] (log M) | EC50[b] (nM) | Emax[a] (RLU) | % Control[c] |
| His-Compound 1 | 8.99 ± 0.10 | 1.0 (0.8-1.3) | 1.90E06 ± 3.9E05 | 100 |
| PEG-Compound 1 | 8.44 ± 0.05[d] | 3.6 (3.2-4.1)[d] | 1.60E06 ± 3.7E05 | 84.5 ± 19.8 |
| PEG-Compound 2 | 8.27 ± 0.16[d] | 5.4 (3.7-8.0)[d] | 1.66E06 ± 4.5E05 | 87.8 ± 23.9 |

[a]Mean ± S.D.
[b]Geometric Mean (95% confidence interval)
[c]Control was defined as His-Compound 1
[d]$p < 0.05$ compared to His-Compound 1, ANOVA with Tukey-Kramer post-hoc test.

Figure 64:
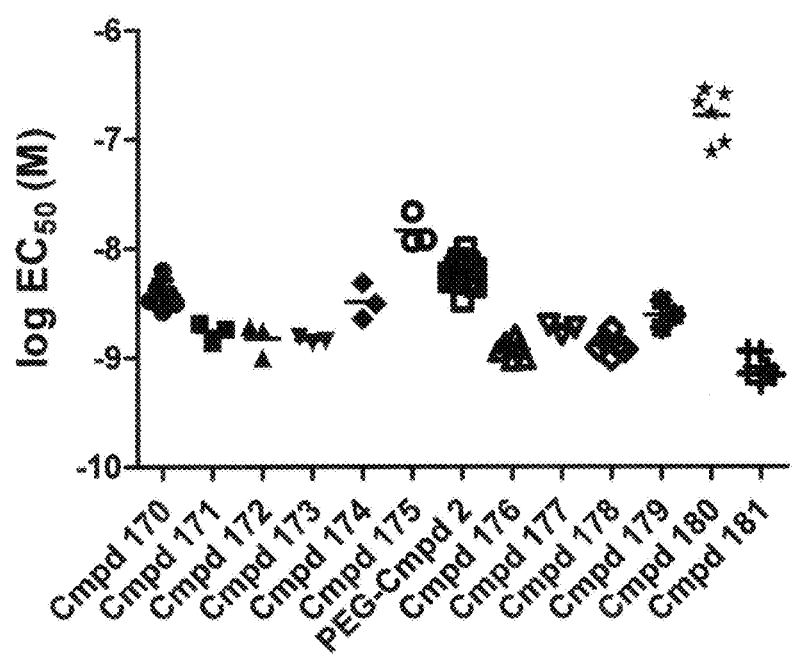
FIG. 64. Potency of FGF-21 variants measured in the cell-based Elk1-luciferase assay. Each data point indicates an individual replicate and the horizontal bar represents the mean value. Values are expressed as the base 10 logarithm of the measured $EC_{50}$ value in moles.

Various Fc-FGF-21 fusion molecules were compared in the cell-based Elk1-luciferase assay. All of the molecules except Compound 180 and Compound 175 exhibited single digit nM potencies or lower and were comparable to or lower than the measured potency of PEG-Compound 2 (FIG. 64 and Table 24 below).

TABLE 24

Geometric Mean EC50 values with 95% confidence intervals.

|  | Cmpd 170 | Cmpd 171 | Cmpd 172 | Cmpd 173 | Cmpd 174 | Cmpd 175 | Cmpd 176 | Cmpd 177 | Cmpd 178 | Cmpd 179 | Cmpd 180 | Cmpd 181 | PEG-Cmpd 2 |
|---|---|---|---|---|---|---|---|---|---|---|---|---|---|
| Geometric Mean (nM) | 3.8 | 1.7 | 1.5 | 1.5 | 3.3 | 14.6 | 1.2 | 1.8 | 1.3 | 2.5 | 164.8 | 0.8 | 5.9 |
| Lower 95% CI of mean | 2.8 | 1.0 | 0.6 | 1.2 | 1.3 | 6.1 | 1.0 | 1.4 | 1.0 | 1.2 | 92.9 | 0.6 | 4.9 |
| Upper 95% CI of mean | 5.2 | 2.9 | 3.6 | 1.7 | 8.4 | 34.8 | 1.5 | 2.4 | 1.6 | 5.0 | 291.7 | 1.1 | 7.1 |

Example 18

Effects of FGF-21 Variant Compounds on Adiponectin Levels in C57BL/6J Mice

FGF21 stimulates secretion of adiponectin from adipocytes, and the broad distribution of adiponectin receptors provides a potential avenue by which FGF21 action can be extended to other tissues. Many of the metabolic effects of native FGF21, including its anti-steatotic activity, have been reported to require adiponectin in the mouse (Lin, Z. et al., Cell Metab. 17: 779-789 (2013); Holland et al., Cell Metab 17: 790-797 (2013), each of which is hereby incorporated by reference in its entirety). The present example reports the effects of single ascending doses of PEG-Compound 2 on selected pharmacodynamic markers of FGF21 activities in normal, non-diabetic C57BL/6J mice.

8 week old male C57BL/6J mice were randomized into the following treatment groups (sample size n=10/group): 1) Vehicle, 2) PEG-Compound 2, 0.03 mg/kg, 3) PEG-Compound 2, 0.1 mg/kg, 4) PEG-Compound 2, 0.3 mg/kg, or 5) PEG-Compound 2, 1.0 mg/kg, and dosed subcutaneously with their respective treatment at 5 ml/kg. Following dosing in the non-fasted state, blood samples were centrifuged and 20 μl plasma was aliquoted for the quantitative determination of total and high molecular weight (HMW) Adiponectin (Alpco Diagnostics, Salem, N.H., cat #47-ADPMS-E01). Mice were again bled in the non-fasted state 24, 48, 72, and 144 hours following the single acute dose for plasma glucose and adiponectin analyses, and body weight was measured prior to each bleed.

The plasma concentrations of total and high molecular weight (HMW) adiponectin were measured by following the manufacturer's protocol for the Mouse Total and HMW ELISA kit (Alpco Diagnostics, Salem, N.H.). Plasma exposures of PEG-Compound 2 were determined by ELISA. Statistical analysis of all the data was performed using one-way ANOVA followed by Dunnett's t-test using the Vehicle group as the control (JMP from SAS, Cary, N.C.). Statistical significance was determined at probability (P)<0.05.

Figure 65:
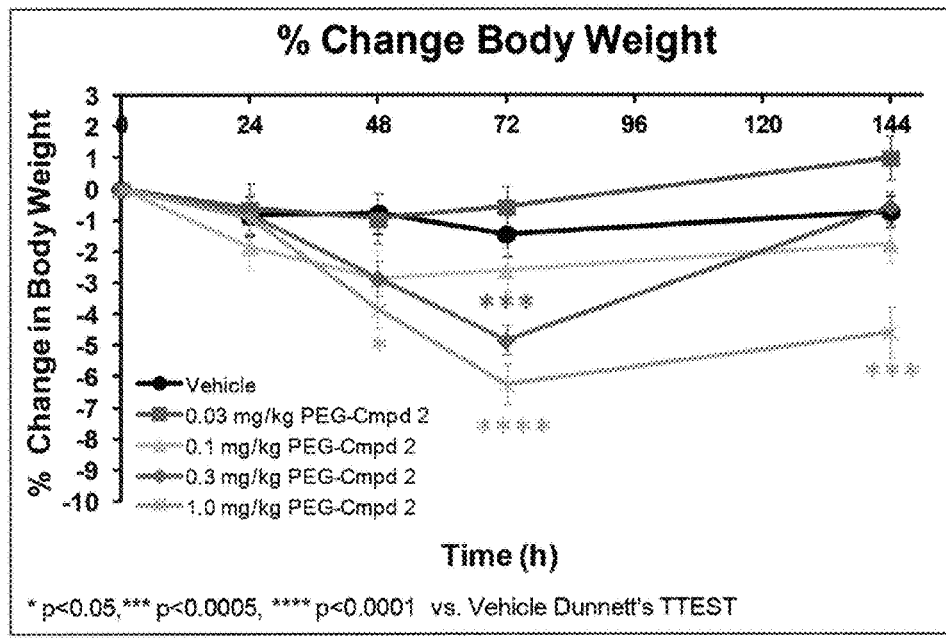
FIG. 65. Effect of single, acute doses of PEG-Compound 2 on percent change in body weight in C57BL/6J mice. C57BL/6J mice were treated with either vehicle (250 mM Sucrose/20 mM Tris, pH 8.3), or PEG-Compound 2 at 0.03, 0.1, 0.3, or 1.0 mg/kg, n=10/group. Percent change in body weights in C57BL/6J mice at baseline (0), 24, 48, 72 and 144 h post SC dose was determined. All values are mean± SEM *P<0.05, *P<0.001, **P<0.0001 vs. vehicle, (one-way ANOVA followed by Dunnett's test).

Body weight was determined at baseline (0), 24, 48, 72 and 144 hours after the treatment. When converted to percent change from baseline (day 0) body weight, a significant dose-dependent decrease was observed in response to single SC doses of PEG-Compound 2 (FIG. 65). The percent weight loss effect was maximal at 72 hours post-dose and began to return to baseline values by day 6, with the response to 1.0 mg/kg dose of PEG-Compound 2 remaining significantly decreased as compared to that in the vehicle group. Body weight was significantly decreased compared to the vehicle treatment group for the 0.3 mg/kg treatment group at 72 hours (P<0.001) and for the 1.0 mg/kg treatment group at 48 hours (P<0.05), 72 hours (P<0.0001) and 144 hours (P<0.001).

Figure 66A:
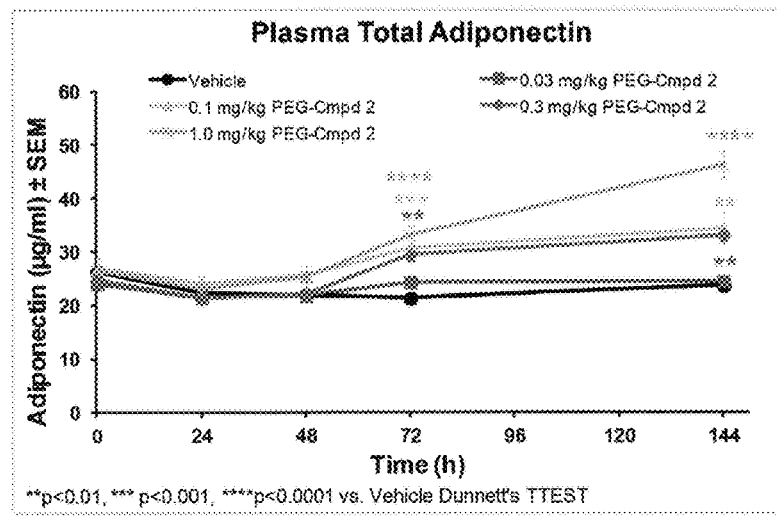
FIG. 66A. Effect of single, acute doses of PEG-Compound 2 on plasma total adiponectin in C57BL/6J mice. Plasma total adiponectin concentration at baseline (0), 24, 48, 72, and 144 h post SC dose was determined. Non-fasted C57BL/6J mice were treated with either vehicle (250 mM Sucrose/20 mM Tris, pH 8.3), or PEG-Compound 2 at 0.03, 0.1, 0.3, or 1.0 mg/kg, n=10/group. All values are mean±SEM P<0.01, *P<0.001, **** P<0.0001 vs. vehicle, (one-way ANOVA followed by Dunnett's).

Plasma total adiponectin concentrations were significantly increased relative to vehicle by treatment with 0.1, 0.3 and 1.0 mg/kg doses of PEG-Compound 2 at 72 and 144 hours post-dose (FIG. 66A). The 0.03 mg/kg dose of PEG-Compound 2 tested did not significantly increase total adiponectin effects compared to vehicle at any point measured. Plasma total adiponectin was significantly increased in the 0.1 mg/kg treatment group at 72 hours (P<0.001) and 144 hours (P<0.01), in the 0.3 mg/kg treatment group at 72 hours (P<0.01) and 144 hours (P<0.01), and in the 1 mg/kg treatment group at 72 hours (P<0.0001) and 144 hours (P<0.0001).

Figure 66B:
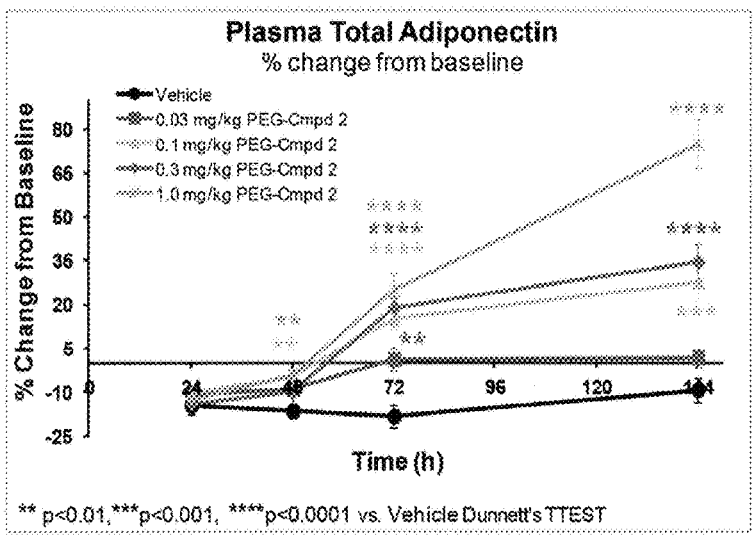
FIG. 66B. Effect of single, acute doses of PEG-Compound 2 on percent change in plasma total adiponectin in C57BL/6J mice. C57BL/6J mice were treated with either vehicle (250 mM Sucrose/20 mM Tris, pH 8.3), or PEG-Compound 2 at 0.03, 0.1, 0.3, or 1.0 mg/kg, n=10/group. Plasma total adiponectin concentration was determined at baseline 24, 48, 72, and 144 h post SC dose, and percent change relative to baseline was determined. All values are mean±SEM P<0.01, *P<0.001, **** P<0.0001 vs. vehicle, (one-way ANOVA followed by Dunnett's test).

When expressed as percent change from baseline, plasma total adiponectin concentrations were significantly increased compared to vehicle by treatment with all doses of PEG-Compound 2 at some of the time-points (FIG. 66B). There was no significant difference in percent change from baseline in total adiponectin compared to vehicle 24 hours after treatment with any dose of PEG-Compound 2, and at 72 hours post-dose, all doses of PEG-Compound 2 produced statistically significant increases compared to vehicle. The maximal change observed was a 75% increase in change from baseline adiponectin 144 hours post-dose with 1 mg/kg PEG-Compound 2. Percentage change in plasma total adiponectin was significantly increased in the 0.03 mg/kg treatment group at 72 hours (P<0.01), in the 0.1 mg/kg treatment group at 48 hours (P<0.01), 72 hours (P<0.0001) and 144 hours (P<0.001), in the 0.3 mg/kg treatment group at 72 hours (P<0.0001) and 144 hours (P<0.0001), and in the 1.0 mg/kg treatment group at 48 hours (P<0.01), 72 hours (P<0.0001) and 144 hours (P<0.0001).

Plasma HMW adiponectin concentrations were significantly increased compared to vehicle by treatment with the 0.1 and 1.0 mg/kg doses of PEG-Compound 2, while the 0.03 and 0.3 mg/kg dose of PEG-Compound 2 did not significantly increase HMW adiponectin compared to vehicle at any point measured (data not shown).

When measured at the end of the study 144 hours after treatment, plasma concentrations of PEG-Compound 2 increased dose-dependently for both the active, carboxy (C)-terminal intact and the total (intact and proteolyzed) forms of the molecule Table 25.

TABLE 25

Plasma concentrations of total and C-terminal
intact PEG-Compound 2 after single SC doses

| Form of PEG- | Dose (mg/kg) | | | |
|---|---|---|---|---|
| Compound 2 | 0.03 | 0.1 | 0.3 | 1.0 |
| Total (ng/ml) | 1.5 ± 0.21 | 12 ± 0.89 | 39 ± 3.2 | 222 ± 15 |
| C-terminal Intact (ng/ml) | 0.40 ± 0.11 | 5.2 ± 0.38 | 19 ± 1.4 | 135 ± 8.6 |

Total and C-terminal intact PEG-Compound 2 in C57BL/6J mouse plasma 144 hours post SC dose.

All values are Mean±S.E.M.

A similar protocol was followed with molecules PEG-Compound 20 Compound 105, Compound 112, Compound 182, Compound 171, Compound 170, Compound 181, and PEG-Compound 1, with 9-11 week old C58BL/6J mice, except that total adiponectin was only measured at baseline, 3 days (72 hours) and 6 days (144 hours) post-dose. The compounds were expressed in E. coli except Compound 181, which was expressed in HEK cells. All compounds significantly increased plasma total adiponectin compared to vehicle on Day 3 and/or Day 6 at certain doses tested (see FIG. 67A-E).

Figure 67A:
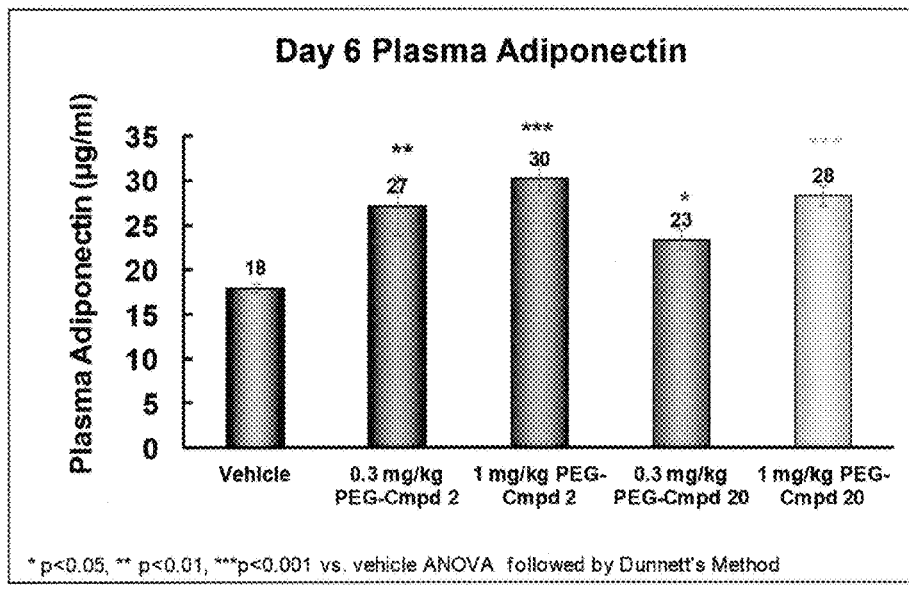
FIG. 67A. Effects of FGF-21 variants on plasma total adiponectin in C57BL/6J mice. Both PEG-Compound 2 and PEG-Compound 20 treatment resulted in significant increases in total plasma adiponectin 6 days post-dose at both 0.3 and 1 mpk doses (*P<0.05, P<0.01, *P< 0.001).

At dosages of 0.3 mg/kg and 1 mg/kg, PEG-Compound 2 and PEG-Compound 20 each resulted in significant increases in plasma total adiponectin 6 days post-dose (P<0.001 for 1 mg/kg of either compound, P<0.01 for 0.3 mg/kg PEG-Compound 2, and P<0.05 for 0.3 mg/kg PEG-Compound 20) (FIG. 67A).

Figure 67B:
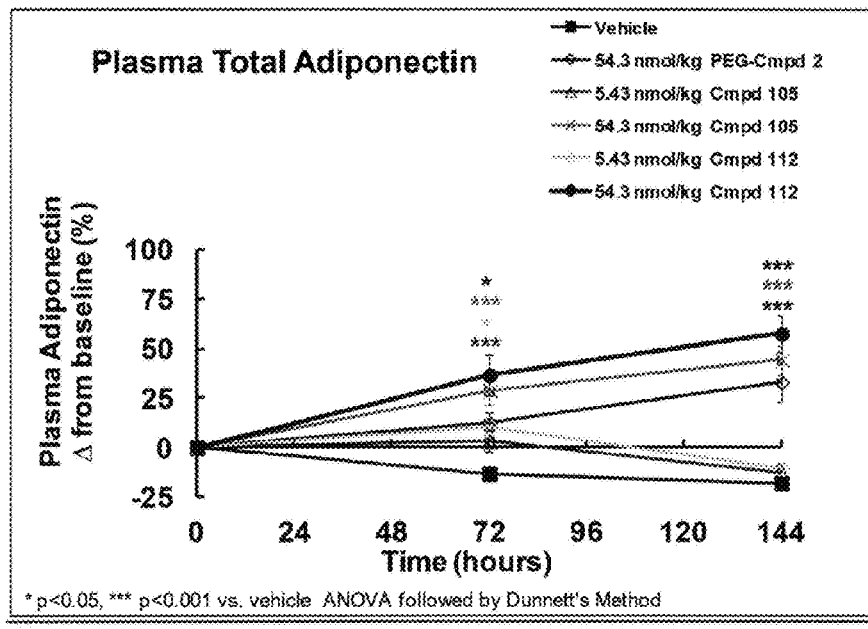
FIG. 67B. Effects of FGF-21 variants on plasma total adiponectin in C57BL/6J mice. The 54.3 nmol/kg dose of PEG-Compound 2, Compound 105, and Compound 112 significantly increased the percentage change in total adiponectin as compared to the percentage change in total adiponectin in vehicle-treated controls on Days 3 and 6.

At a dosage of 54.3 nmol/kg, the percentage change from baseline in plasma total adiponectin was significantly increased by PEG-Compound 2, Compound 105, and Compound 112 (as compared to vehicle-treated controls) on Days 3 and 6 (P<0.001 for all data points except PEG-Compound 2 at day 3, P<0.05) (FIG. 67B). Additionally, the 5.43 nmol/kg dose of Compound 112 significantly increased the percentage change in plasma total adiponectin, as compared to vehicle-treated controls, on Day 3 only (P<0.05) (FIG. 67B).

Figure 67C:
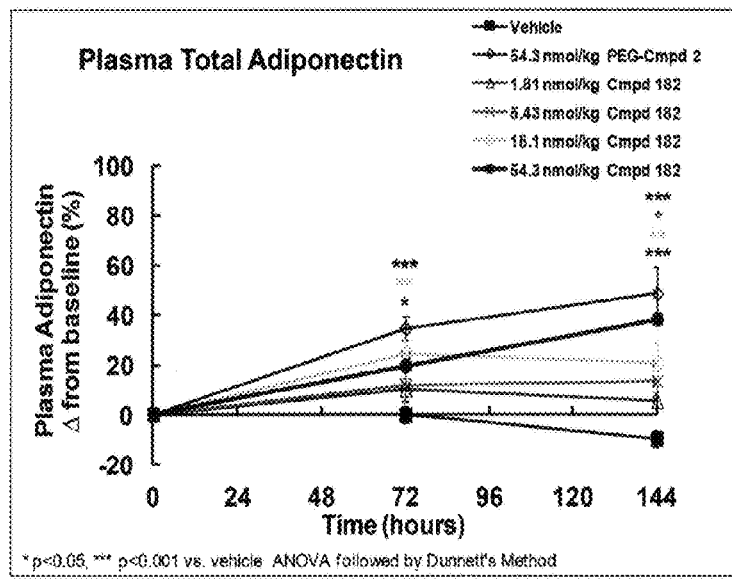
FIG. 67C. Effects of FGF-21 variants on plasma total adiponectin in C57BL/6J mice. Both 18.1 and 54.3 nmol/kg doses of Compound 182 significantly increased the percentage change in plasma total adiponectin (as compared to the percentage change observed in the vehicle controls) on Days 3 and 6.

The percentage change from baseline in plasma total adiponectin was significantly increased by Compound 182 at 18.1 nmol/kg (P<0.01 on both Days 3 and 6) and 54.3 nmol/kg dose (P<0.001 and P<0.05, respectively, on Days 3 and 6) (FIG. 67C). The increase in the percentage change in plasma total adiponectin for the 5.43 nmol/kg dose of Compound 182 was significant on Day 6 only (P<0.05). Additionally, PEG-Compound 2 (54.3 nmol/kg dose) significantly increased the percentage change in plasma total adiponectin on both Day 3 and Day 6 (P<0.001 on both days) (FIG. 67C).

Figure 67D:
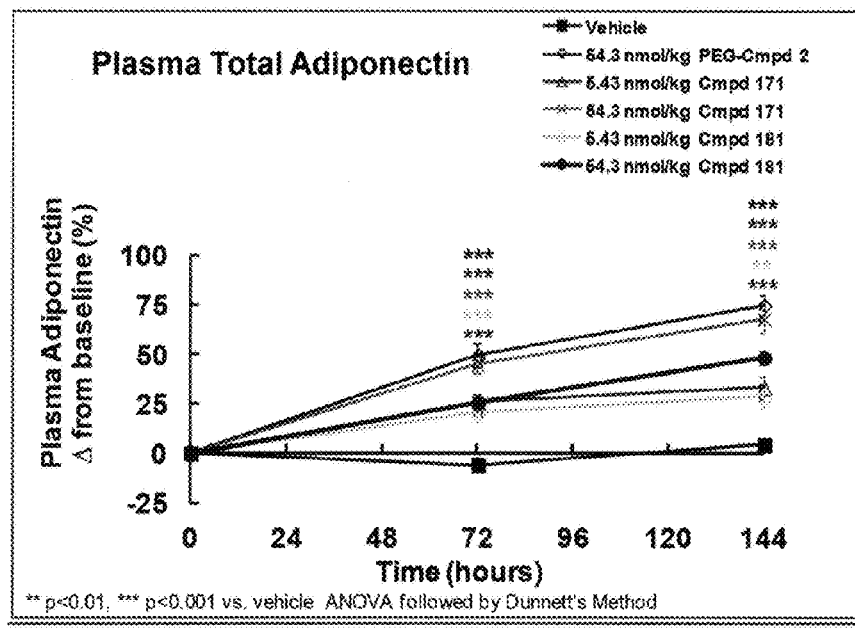
FIG. 67D. Effects of FGF-21 variants on plasma total adiponectin in C57BL/6J mice. Both Compound 171 and Compound 181 significantly increased the percentage change from baseline plasma total adiponectin on Days 3 and 6 post-dose, in a dose-dependent manner, compared to the vehicle-treated control.

The percentage change from baseline in plasma total adiponectin was significantly increased by both Compound 171 and Compound 181 at both Day 3 and Day 6 in a dose-dependent manner, compared to the vehicle-treated control (P<0.001 for all data points except P<0.01 for the 5.43 nmol/kg dose of Compound 181 at Day 6) (FIG. 67D). Additionally, PEG-Compound 2 (54.3 nmol/kg dose) significantly increased the percentage change in plasma total adiponectin on both Day 3 and Day 6 (P<0.001 on both days) (FIG. 67D).

Figure 67E:
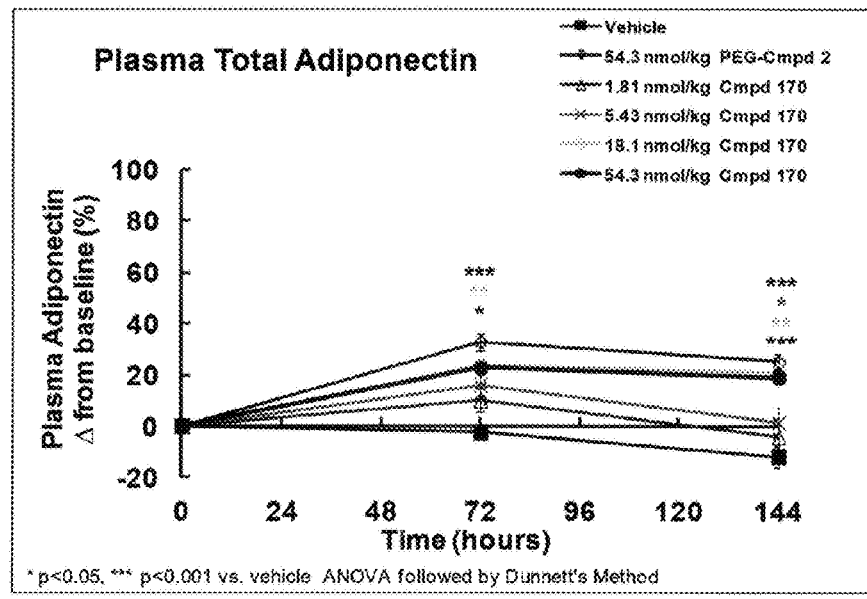
FIG. 67E. Effects of FGF-21 variants on plasma total adiponectin in C57BL/6J mice. The percentage change from baseline in plasma total adiponectin (as compared to vehicle) was significantly increased by Compound 170 on Days 3 and 6 at 18.1 nmol/kg and 54.3 nmol/kg.

The percentage change from baseline in plasma total adiponectin was significantly increased by Compound 170 on Days 3 and 6 at 18.1 nmol/kg (P<0.01, both days) and 54.3 nmol/kg (P<0.05 on Day 3 and P<0.001 on Day 6); the increase in the percentage change in plasma total adiponectin for the 5.43 nmol/kg dose was significant on Day 6 only (P<0.05) (FIG. 67E). Additionally, PEG-Compound 2 (54.3 nmol/kg dose) significantly increased the percentage change in plasma total adiponectin on both Day 3 and Day 6 (P<0.001 on both days) (FIG. 67E).

Figure 67F:
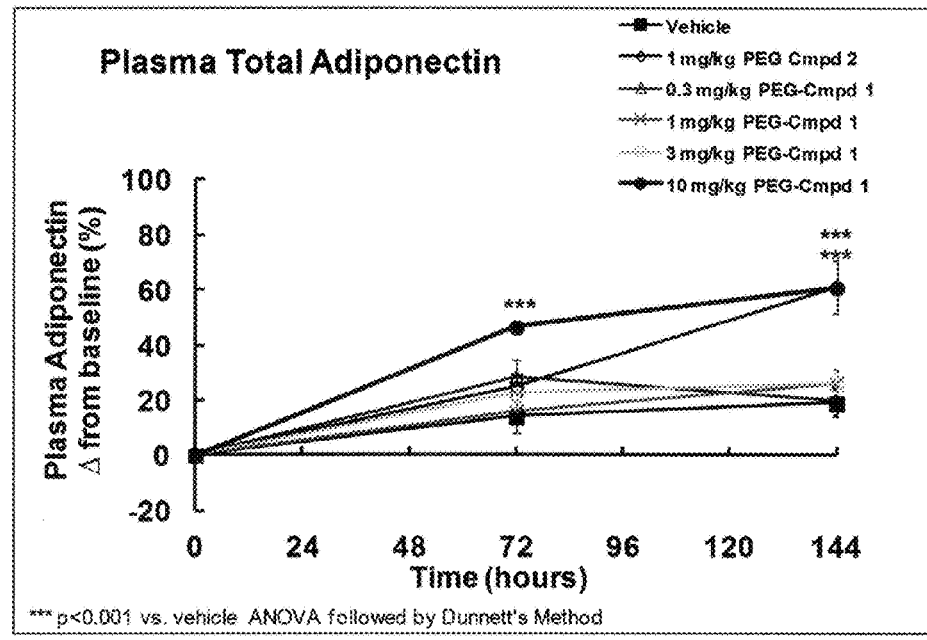
FIG. 67F. Effects of FGF-21 variants on plasma total adiponectin in C57BL/6J mice. The 10 mg/kg dose of PEG-Compound 1 significantly increased the percentage change from baseline in plasma total adiponectin as compared to vehicle-treated controls on Days 3 and 6.

The percentage change from baseline in plasma total adiponectin was significantly increased by Compound 1 on Days 3 and 6 at a dose of 10 mg/kg (P<0.001, both days). Additionally, PEG-Compound 2 (1 mg/kg) significantly increased the percentage change in plasma total adiponectin on Day 6 (P<0.001) (FIG. 67F).

Example 19

Effects on Diabetic Kidney Disease in db/db Mice

Uninephrectomized (unix) db/db mice are a rodent model of diabetic kidney disease (DKD) in which the surgical removal of one kidney exacerbates and accelerates the renal injury and dysfunction that results from type 2 diabetes (Ninichuk et al., Eur J Med Res 12:351-355 (2007), which is hereby incorporated by reference in its entirety).

4-Week Study

In this study, db/db mice at 8 wk of age were subjected to left nephrectomy under anesthesia with 5% isoflurane to hasten the development of diabetic nephropathy. Three weeks after uninephrectomy, groups of fourteen uninephrectomized mice were distributed to either PEG-Compound 2 or vehicle treatment, based on randomization with urine albumin to creatinine ratio (uACR), blood glucose, and body weight in that order. A group of db/m lean mice (n=12) was assigned as the non-diabetic normal control. Treatment with either PEG-Compound 2 or vehicle in the uninephrectomized db/db mice started at three weeks post surgery. 0.15 mg/kg PEG-Compound 2 was administered twice weekly (BIW) by subcutaneous (SC) injection in a vehicle containing 250 mM Sucrose, 20 mM Tris, pH 8.3. The baseline blood samples were collected via retro-orbital bleeding under anesthesia with 5% isoflurane. Multiple three-hour spot urine collections for measurements of urine glucose, albumin and creatinine were obtained from each mouse at baseline, and following 2, 3, and 4 weeks of treatment.

Mice were sacrificed under isoflurane anesthesia following four weeks of treatment. Statistical analysis of the data was performed using one-way analysis of variance (ANOVA) followed by Dunnett's test, unless otherwise indicated (JMP statistical analysis software, SAS, Cary, N.C.). Statistical significance was determined at probability (P)<0.05. Four mice in the unix db/db Vehicle group were excluded from data analyses (except for food and water consumption) because they exhibited severe pyelonephritis.

The PEG-Compound 2 and Vehicle groups exhibited similar levels of plasma glucose (765±42 vs 815±46, P>0.05) at baseline prior to treatment. Following four weeks of treatment at the end of the study, plasma glucose in the PEG-Compound 2 group was 23% lower than that of the Vehicle group (485±39 vs 629±43, P<0.05) (see Table 26).

TABLE 26

PEG-Compound 2 Treatment Lowered Blood Glucose (mg/dL)[a].

| Group | Baseline Blood Glucose | Terminal Blood Glucose |
|---|---|---|
| Lean | 194.9 ± 6.4 | 181.0 ± 19.5 |
| Unix db/db, Vehicle | 814.8 ± 45.6[b] | 628.6 ± 39.0[b] |
| Unix db/db, PEG-Compound 2 | 628.6 ± 39.0[b] | 485.2 ± 42.5[c] |

[a]Data are expressed as Mean ± S.E.M.
[b]$P < 0.05$, disease (unix db/db, Vehicle, n = 9) versus normal (db/m lean, n = 10).
[c]$P < 0.05$, PEG-Compound 2 (n = 14) versus Vehicle (n = 9).

After the initiation of treatment with PEG-Compound 2, urine glucose levels decreased progressively. Urinary glucose levels of the PEG-Compound 2 group showed significant reductions of 71%, 73%, and 84% with 2, 3 and 4 weeks of treatment, respectively, when compared to the Vehicle group (all $P<0.05$; Table 5).

TABLE 27

PEG-Compound 2 Reduced Urine Glucose (mg/dL)[a].

| Group | 2 wks dosing | 3 wks dosing | 4 wks dosing |
|---|---|---|---|
| Lean | 17 ± 3 | 12 ± 1 | 40 ± 5 |
| Unix db/db, Vehicle | 8719 ± 694[b] | 8550 ± 204[b] | 9796 ± 378[b] |
| Unix db/db, PEG-Compound 2 | 2537 ± 818[c] | 2284 ± 715[c] | 1565 ± 410[c] |
| % reduction | 71% | 73% | 84% |

[a]Data expressed as Mean ± S.E.M.
[b]$P < 0.05$, disease (unix db/db, Vehicle, n = 9-10) versus normal (db/m lean, n = 10-12).
[c]$P < 0.05$, PEG-Compound 2 (n = 13-14) versus Vehicle (n = 9-10).

Microalbuminuria (Urine Albumin to Creatinine Ratio (uACR) >30 μg/mg) has been reported in the literature to be one of the most sensitive and specific indicators of early nephropathy in diabetic patients (see Chae et al., J Korean Med Sci. 2012; 27: 784-787, which is hereby incorporated by reference in its entirety). Microalbumin was measured from 3 hrs of spot urine collection and the values were normalized to urine creatinine Nondiabetic db/m lean mice had mean uACR values ranging from 21 to 37 μg/mg during the study course (FIG. 68 and Table 28).

Figure 68:
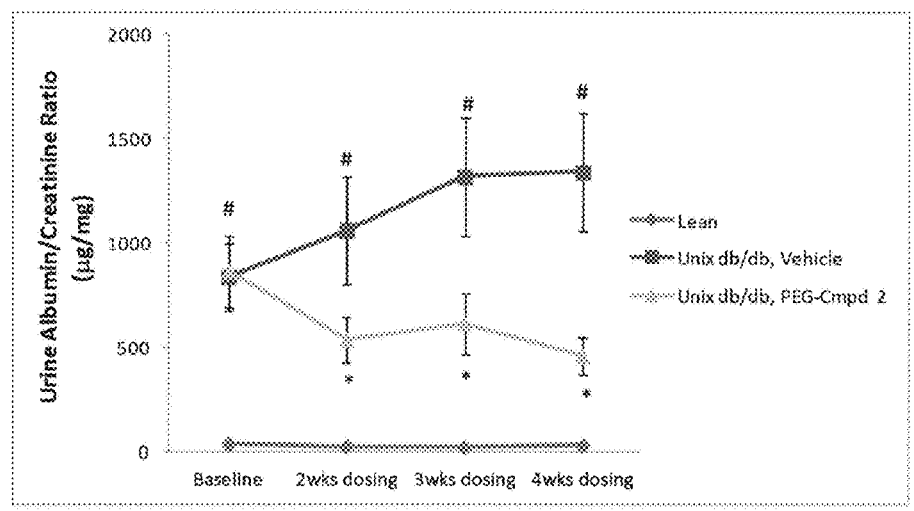
FIG. 68. Effect of PEG-Compound 2 on Albuminuria (Urine ACR). # P<0.05, disease (unix db/db, Vehicle, n=9-10) versus normal (db/m lean, n=10-12). * P<0.05, PEG-Compound 2 (n=13-14) versus Vehicle. ANOVA with Dunnett's post-hoc test for each pair at individual time points. Data expressed as Mean±S.E.M.

During the study, uACR in unix db/db mice increased significantly from 23- to 62-fold (all $P<0.05$) compared to non-diabetic, lean db/m mice (FIG. 68 and Table 28). The uACR of the Vehicle-treated group progressed from 838±159 μg/mg at baseline to 1341±284 μg/mg after 4 weeks (Table 28), consistent with progressive renal injury.

Compared to the Vehicle group, PEG-Compound 2-treated unix db/db mice showed significant decreases in uACR values of 49%, 53% and 66% with 2, 3, and 4 weeks of treatment, respectively (all $P<0.05$; FIG. 68). The uACR values after PEG-Compound 2 treatment were lower than those measured at the pre-treatment baseline (Table 28).

Kidney wet weight reflects the status of renal hypertrophy due to hyper-filtration in diabetes mellitus. Mean kidney weight was significantly greater in unix db/db mice compared to non-diabetic lean mice, with a 59% increase in the kidney weight of unix db/db mice treated with vehicle. Treatment with PEG-Compound 2 for four weeks significantly inhibited the kidney weight increase in the diabetic mice (286±6.3 versus 253±7.4, Vehicle versus PEG-Compound 2, $P<0.05$).

8-Week Study

At 8 wk of age, db/db mice were subjected to left nephrectomy under 3% isoflurane in oxygen to accelerate the development of diabetic nephropathy. Three weeks after uninephrectomy, groups of fourteen uninephrectomized mice were blocked, randomized, and distributed to either PEG-Compound 2 at 0.15 mg/kg or 0.015 mg/kg or the vehicle treatment, based on urine albumin to creatinine ratio (uACR), blood glucose, and body weights in that order. A group of db/m lean mice (n=11) was assigned as the non-diabetic normal control. Twice weekly subcutaneous treatment with PEG-Compound 2 at either 0.15 or 0.015 mg/kg or the vehicle in the unix db/db mice started at three weeks post surgery. Mice were sacrificed under 3% isoflurane in oxygen followed by cervical dislocation after eight weeks of treatment. Kidneys were excised, decapsulated, and weighed.

The 0.015 mg/kg dose group did not show any significant blood glucose lowering or improvement of renal parameters. The 0.15 mg/kg dose of PEG-Compound 2 significantly lowered blood and urine glucose levels, and reduced albuminuria by ~50%, compared to that in vehicle-treated mice (all $P<0.05$). A cluster of inflammatory and fibrotic genes was significantly up-regulated in the kidneys of uninephrectomized db/db mice versus lean mice, and treatment with PEG-Compound 2 at 0.15 mg/kg significantly reduced expression of these genes toward levels seen in lean db/m control mice. Mean kidney wet weight was also significantly higher in uninephrectomized db/db mice compared to that of lean mice, and treatment with PEG-Compound 2 at 0.15 mg/kg for 57 days significantly reduced mean kidney wet weight as compared to the vehicle.

Sections from the middle 1/3 of the kidney were stained with hematoxylin and eosin for the histological analysis. Kidney lesions were graded according to the criteria defined in the notes to Table 29. All unix db/db mice exhibited mesangial glomerulopathy, which is the expected phenotype

TABLE 28

PEG-Compound 2 Reduced uACR (μg/mg)[a].

| Groups | Baseline | 2 wks dosing | 3 wks dosing | 4 wks dosing |
|---|---|---|---|---|
| Lean | 36.7 ± 2.6 | 26.3 ± 4.3 | 21.4 ± 2.7 | 30.1 ± 2.8 |
| Unix db/db, Vehicle | 838.2 ± 159.4[b] | 1060.2 ± 256.9[b] | 1319.9 ± 282.3[b] | 1341.3 ± 283.5[b] |
| Unix db/db, PEG-Compound 2 | 865.8 ± 170.8 | 538.5 ± 107.5[c] | 616.1 ± 145.2[c] | 460.6 ± 92.7[c] | of this model (Table 29). Treatment with PEG-Compound 2 at 0.15 mg/kg, but not at 0.015 mg/kg, appeared to reduce the severity of the mesangial glomerulopathy. A few unix db/db mice exhibited tubular-interstitial lesions secondary to glomerulopathy, which is consistent with the underlying pathogenesis of the model.

These observations provide evidence that PEG-Compound 2 at 0.15 mg/kg is renoprotective in the setting of chronic type 2 diabetes.

TABLE 29

PEG-Compound 2: Incidence and Grade of Kidney Lesions.

| | | Treatment (mg/kg) | | |
|---|---|---|---|---|
| | | 0 (vehicle control) | 0.015 | 0.15 |
| | | No. of Mice | | |
| Locale | Grade | 9 | 8 | 9 |
| Glomeruli[a] | | 9 | 8 | 9 |
| | 1 | 1 | 1 | 6 |
| | 2 | 5 | 2 | 3 |
| | 3 | 3 | 5 | — |
| Tubules/Interstitium[b] | | 3 | 3 | 4 |
| | 1 | 2 | 2 | 4 |
| | 2 | 1 | 1 | — |
| Pelvis[c] | | 2 | 1 | 2 |
| | 1 | 2 | — | 1 |
| | 2 | — | 1 | 1 |

[a]Glomerular mesangial expansion is focal or diffuse, and segmental or global. Grade 2 is based on an estimate of >50% glomeruli with mesangial expansion, and/or an additional mesangial, capillary, epithelial, or capsular lesion in at least 1 glomerulus; grade 3 is based on more than one of these additional glomerular lesions.
[b]Tubular lesions include dilatation, atrophy, and/or hyperplasia; interstitial lesions typically are associated with glomerular lesions and characterized by minimal inflammation or localized peri-tubular fibrosis. Grade 1 is focal; grade 2 is multifocal with 2 to 4 foci.
[c]Suppurative inflammation; grade 1 is based on inflammation limited to the pelvic epithelium; grade 2 is based on extension into the medulla or peri-pelvic cortex.

Example 20

Effects on Cardiac Hypertrophy and Cardiac Fibrosis in the Isoproterenol Infused Balb/C Mouse The isoproterenol (Iso)-infused Balb/c mouse is a rodent model of cardiac fibrosis and hypertrophy.

Male Balb/c mice at 10 to 12 wks were randomized based on body weight prior to drug administration. Iso or vehicle (0.02% ascorbic acid in saline) was administered subcutaneously via osmotic mini-pump for 3 wks. Mice were concurrently dosed twice weekly (BIW) with 0.5 mg/kg PEG-Compound 2 or Vehicle over the course of 3 wks. The animals were then euthanized and the hearts were removed at the great vessels and blotted lightly to remove any blood in the ventricles and then weighed. From the remaining 24 mice in each group, the entire heart was frozen on dry ice and stored at $\leq -70°$ C. for hydroxyproline (HP) analysis.

Cardiac HP content (Cardiac fibrosis endpoint) analysis was carried out using total collagen assay kit according to the manufacturer's instructions (Quickzyme Biosciences, Netherlands).

Figure 69:
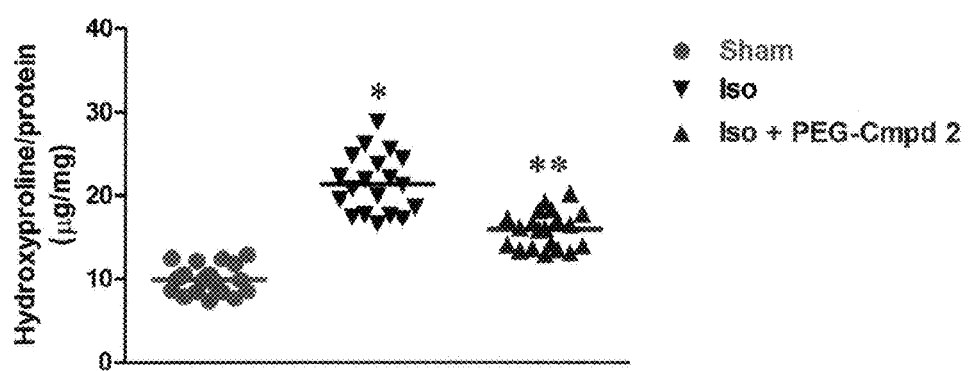
FIG. 69. Cardiac hydroxyproline (HP) content is shown at week 3 of treatment with isoproterenol and PEG-Compound 2. Each data point represents an individual mouse whole heart HP content normalized to protein. *: P<0.05, vs Sham+Vehicle, **: P<0.05, vs Iso+Vehicle (One-way ANOVA followed by Bonferroni's test).

At the end of the 3-wk in-life phase, whole heart HP content was measured. Normalized HP content increased 114% ($P<0.05$) in the Iso+Vehicle group (21.35±0.81 μg/mg) compared to the Sham+Vehicle group (9.96±0.38 μg/mg). This indicated that cardiac fibrosis had been established in response to the Iso infusion in the Balb/c mice. Cardiac HP content in mice receiving Iso+PEG-Compound 2 (0.5 mg/kg) (15.91±0.49 μg/mg) was significantly less than in the Iso+Vehicle animals (FIG. 69 and Table 30). Thus, when administered in a preventative mode, PEG-Compound 2 (0.5 mg/kg) reduced the extent of cardiac hypertrophy and fibrosis.

TABLE 30

Cardiac HP content at week 3 of treatment with isoproterenol and PEG-Compound 2. Data represent whole heart HP content normalized to protein. All values are Mean ± S.E.M.

| | Sham + Vehicle (n) | Iso + Vehicle (n) | Iso + PEG-Cmpd 2 (n) |
|---|---|---|---|
| Hydroxyproline/ protein (μg/mg) | 9.96 ± 0.38 (20) | 21.35 ± 0.81 (19)* | 15.91 ± 0.49 (20)** |

*$P < 0.05$, vs Sham + Vehicle,
**$P < 0.05$, vs Iso + Vehicle (One-way ANOVA followed by Bonferroni's test).

An intervention study was performed to determine if 0.5 mg/kg PEG-Compound 2 could delay progression or reverse pre-established cardiac hypertrophy and fibrosis in Balb/c mice that had already been infused with Iso for 1 wk prior to initiating 3 wk of treatment with the PEG-FGF21 variant. PEG-Compound 2 (0.5 mg/kg) intervention resulted in a 24% reduction in left ventricular (LV) mass (a cardiac hypertrophy endpoint assessed by echocardiography). This observation was associated with a significant, 14% loss of body weight and 23% elevation of circulating levels of adiponectin. No significant difference was observed between the Iso+Vehicle and Iso+PEG-Compound 2 groups in cardiac fibrosis (HP content) or systolic cardiac function (measured by echocardiograph).

Example 21

A Randomized, Placebo-Controlled, Single and Multiple Ascending Dose Study to Evaluate the Safety, Tolerability, Pharmacokinetics and Pharmacodynamics of PEG-Compound 2 in Healthy Subjects The study consists of three parts: Part A: Single Ascending Dose (SAD; Part B: Multiple Ascending Dose (MAD); and Part C: Multiple Ascending Dose in Japanese subjects (J-MAD). PEG-Compound 2 or placebo is administered by subcutaneous injection as a blinded treatment. The subjects in Part A receive a single dose of blinded treatment and the subjects in Parts B and C receive multiple doses of blinded treatment.

The starting dose of 0.6 mg PEG-Compound 2 in SAD is selected. A top dose of 60 mg in SAD and a 60 mg weekly dosing for MAD are also selected to explore the higher end of the projected efficacious dose range. A subject may receive a dose of 0.6 mg, 2 mg, 6 mg, 20 mg, 40 mg, or up to 60 mg PEG-Compound 2 in the SAD arm. In MAD arms, a subject may receive a weekly dose of 2 mg, 6 mg, 20 mg, 40 mg, or 60 mg (QW or BIW).

Healthy male and female subjects aged 21-55 years with BMI between 30 and 40 (Parts A and B) or between 20 and 35 (Part C) may be included.

Primary Endpoints:

The objective (to assess the safety and tolerability of single and multiple subcutaneous doses of PEG-Compound 2 in healthy subjects) will be measured by the following safety endpoints: incidence of AEs, serious AEs, and events of special interest including injection site assessment, AEs leading to discontinuation, and death as well as marked abnormalities in clinical laboratory tests, vital sign measurements, ECGs, physical examinations occurring up to 30 days after the last dose of study medication.

Secondary Endpoints:

Part A: Single-dose pharmacokinetic parameters (Cmax, Tmax, AUC(0-T), AUC(INF), T-HALF, and CLT/F) derived from the C-Terminal intact PEG-Compound 2 serum concentration versus time data, on the day of single dose treatment and for up to 4 weeks washout after the single dose.

Part B and C: Multiple-dose pharmacokinetic parameters (Cmax, Tmax, AUC(TAU) and the accumulation index (AI)) derived from PEG-Compound 2 serum concentration versus time data following first dose and last dose. T-HALF will be calculated only for the last dose. PEG-Compound 2 trough serum concentration (CTrough) will be obtained on selected days during the course of 22 days of treatment and for up to 4 weeks after the last dose.

Example 22

Assessment of PEG-Compound 1, PEG-Compound 2, and Compound 170 in a Mouse Model of NASH Three FGF-21 variants, PEG-Compound 1, PEG-Compound 2, and Compound 170, were tested in the Stelic Institute's 2-hit model of NASH, described above in Example 13. NASH was induced in 40 male mice by a single subcutaneous injection of 200 µg streptozotocin solution 2 days after birth and feeding with high fat diet (HFD; 57% fat by kcal) after 4 weeks of age ("STAM mice"). The mice were administered 3 mg/kg PEG-Compound 1 (n=8), 0.5 mg/kg PEG-Compound 2 (n=8), 2.5 mg/kg Compound 170 (n=8), or vehicle (20 mM Tris/250 mM sucrose, pH 8.3) (n=8), by subcutaneous route twice per week from 7- to 9-weeks of age. These mice were sacrificed at 9-weeks of age for various analyses. Another group of eight mice served as the baseline control and were sacrificed at 7-weeks of age.

Figure 70C:
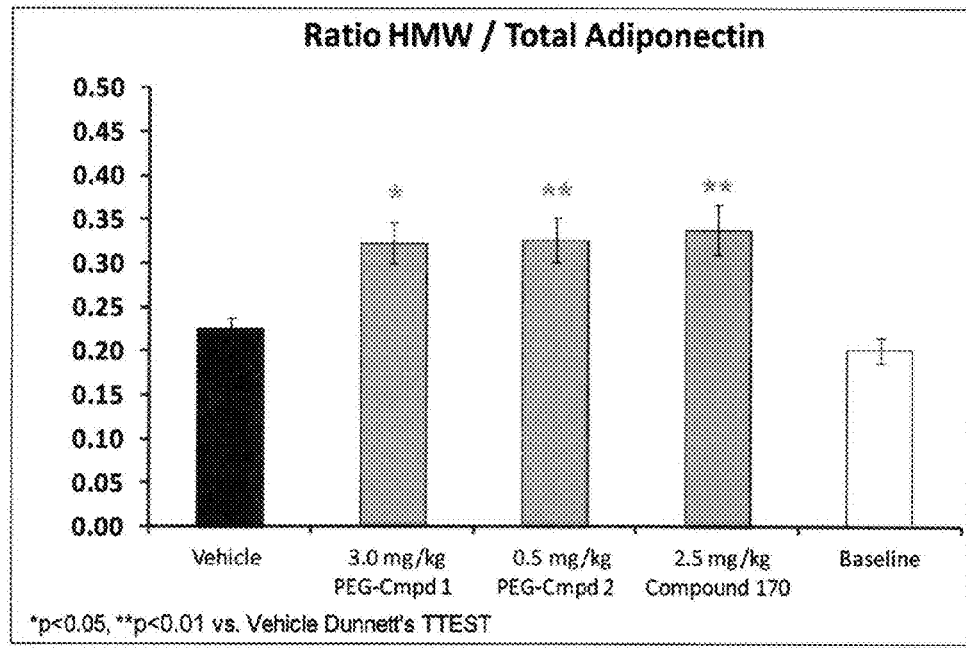

Concentrations of total and high molecular weight (HMW) adiponectin were measured in terminal serum samples prepared from the mice using a commercially available ELISA kit (Alpco catalog number 47-ADPMS-E01) following the manufacturer's protocol. Compared to the Vehicle group, All 3 FGF21 variants significantly increased serum total adiponectin (FIG. 70A) ($p<0.0001$ for PEG-Compound 1, PEG-Compound 2, and Compound 170), serum HMW adiponectin (FIG. 70B) ($p<0.005$, PEG-Compound 1; and $p<0.0001$, PEG-Compound 2, and Compound 170), and the ratio of HMW/total adiponectin (FIG. 70C) ($p<0.05$, PEG-Compound 1; and $p<0.01$, PEG-Compound 2, and Compound 170).

Figure 72A:
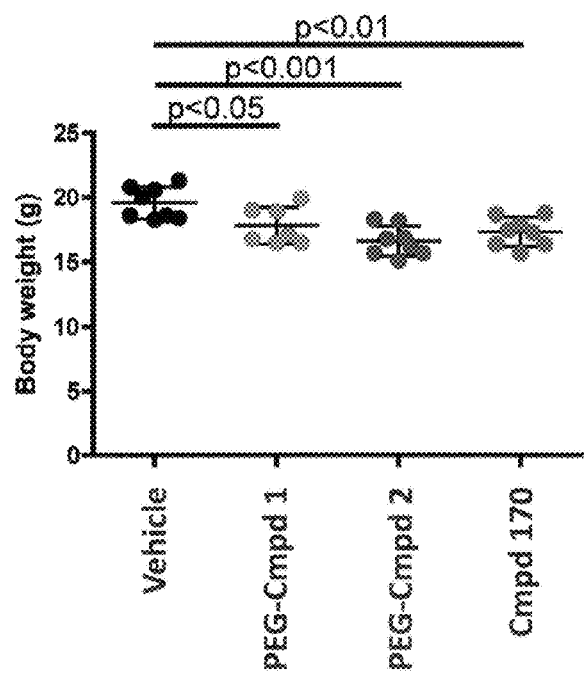
FIG. 72A-G. Effects of FGF-21 variants in a NASH animal model. Following treatment with PEGylated Compound 1 ("PEG-Cmpd 1"), PEGylated Compound 2 ("PEG-Cmpd 2") or Compound 170 ("Cmpd 170"), animals were assessed for body weight (FIG. 72A), liver weight (FIG. 72B), liver-to-body weight ratio (FIG. 72C), liver triglyceride (FIG. 72D), plasma ALT (FIG. 72E), liver cholesterol (FIG. 72F), and plasma triglycerides (FIG. 72G). Statistically significant differences from vehicle-treated controls are as shown. n.s.: no statistically significant difference detected (i.e., P≥0.05).
Figure 72B:
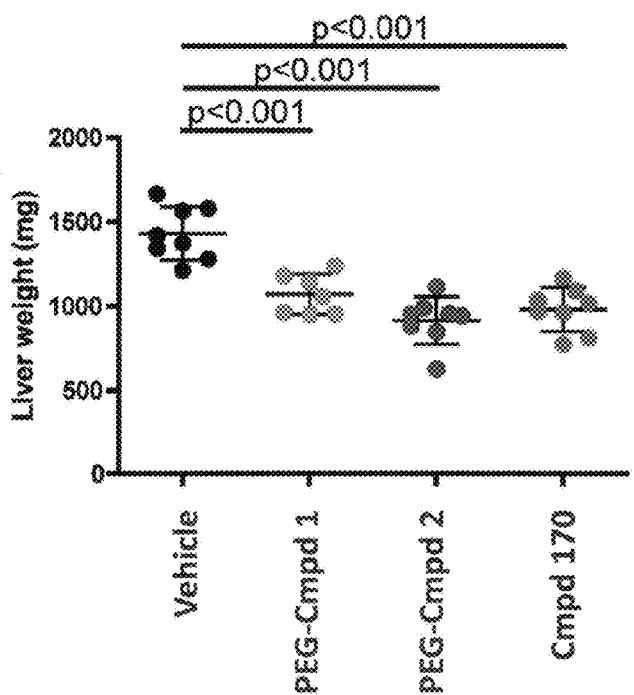
Figure 72C:
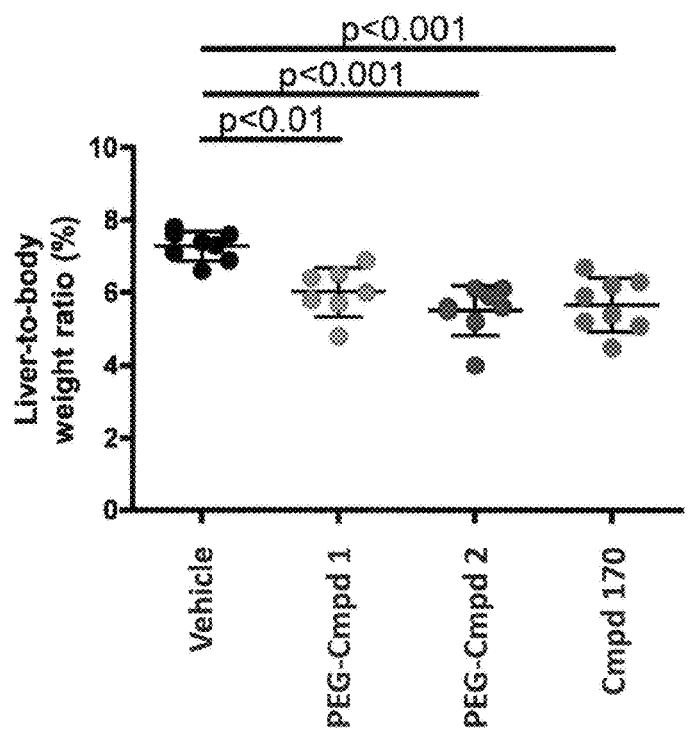
Figure 72D:
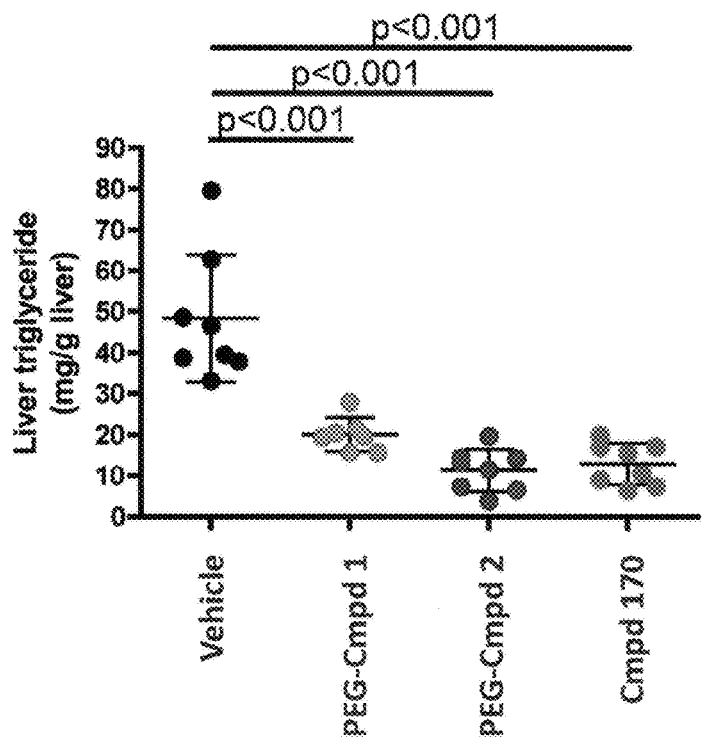
Figure 72E:
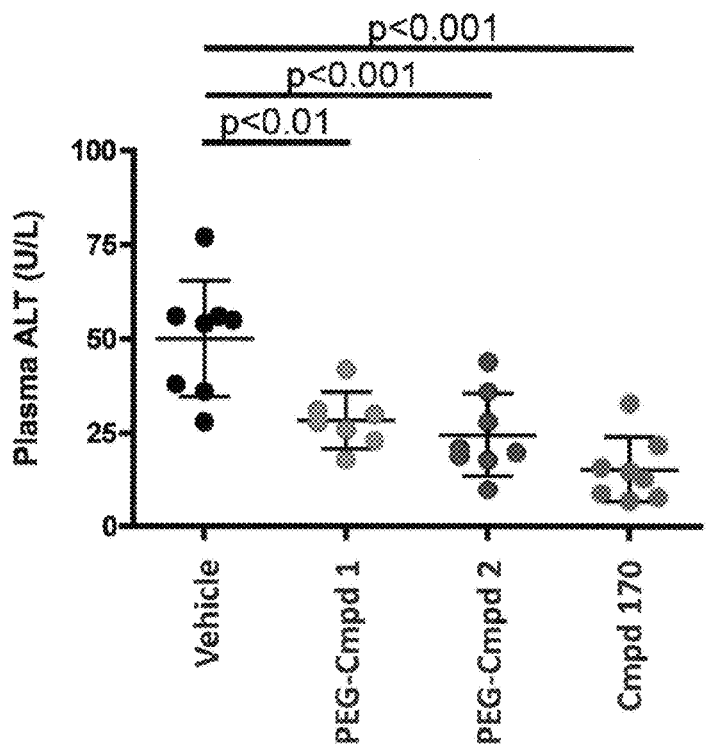
Figure 72F:
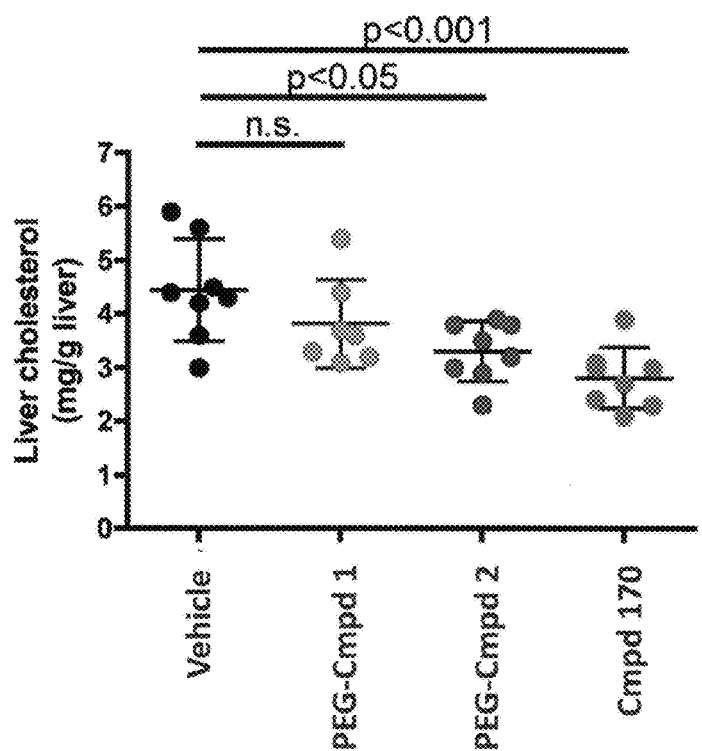
Figure 72G:
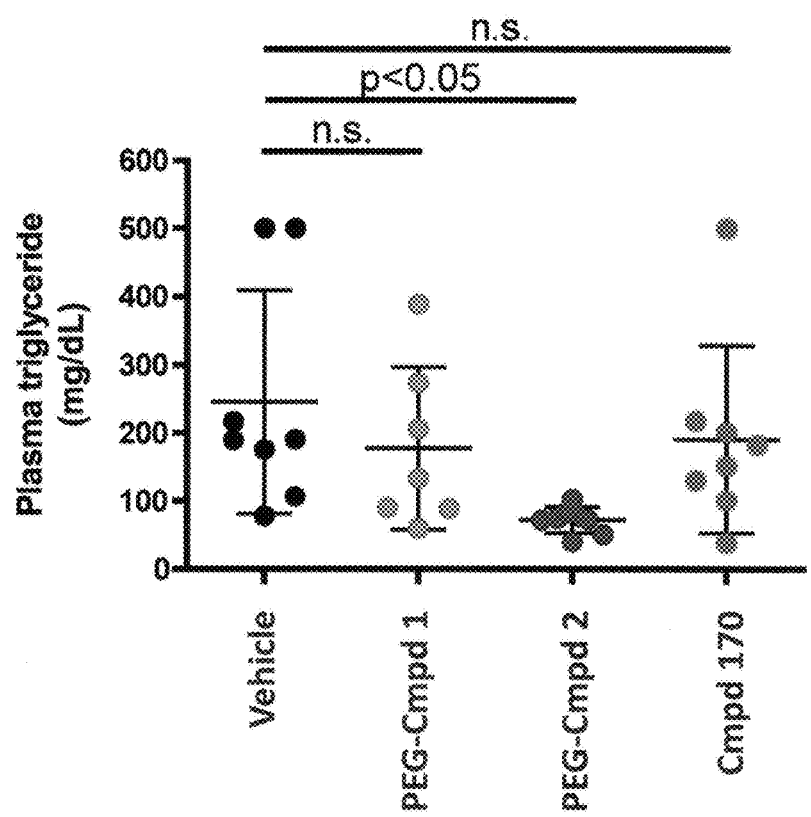

Body weight, liver weight, liver triglyceride, liver cholesterol, and plasma glucose, triglycerides, and ALT levels were determined. All three FGF21 variants significantly reduced body weight (FIG. 72A), liver weight (FIG. 72B), liver-to-body weight ratio (FIG. 72C), liver triglyceride (FIG. 72D), and plasma ALT (FIG. 72E). PEG-Compound 2 and Compound 170 significantly reduced liver cholesterol (FIG. 72F), and PEG-Compound 2 significantly reduced plasma triglycerides (FIG. 72G). No compound significantly decreased plasma cholesterol or glucose (data not shown) in this study.

Example 23

Assessment of PEG-Compound 2 and Compound 170 During 3 Weeks of BIW Dosing in ob/ob Mice Pegylated Compound 2 and Compound 170 were evaluated in a 21-day repeated dosing study. The results demonstrate that both compounds caused reductions in liver weight and dose-dependent reductions in hepatocyte steatosis in the left lateral lobe of the liver, as compared to vehicle.

Male ob/ob mice (Jackson Laboratories, Bar Harbor, Me.) at 8 weeks of age were randomized into 5 groups as described in Example 12. The mice were administered vehicle, Pegylated Compound 2 and Compound 170 subcutaneously twice weekly (BIW) as follows (n=12 for each group): 1) Vehicle (250 mM sucrose/20 mM Tris, pH 8.3); 2) Pegylated Compound 2, 8.14 nmol/kg (0.15 mg/kg); 3) Compound 170, 8.14 nmol/kg; 4) Pegylated Compound 2, 81.45 nmol/kg (1.5 mg/kg); and 5) Compound 170, 81.45 nmol/kg. Body weight, plasma glucose, triglycerides, insulin, nonesterified fatty acids (NEFA), β-OH-butyrate, total adiponectin, and high molecular weight (HMW) adiponectin were determined throughout the 21 day dosing period in the fed state. Glycated hemoglobin (HbA1c) in whole blood was determined at study start and termination. Liver weight and liver triglycerides were determined at study termination. Liver histology was performed with the left lateral lobe of the liver to evaluate hepatocyte steatosis. The tissue was fixed in 10% buffered formalin and processed for histology. Sections of paraffin-embedded tissues were stained with hematoxylin and eosin using standard methods. The first 6 mice in each treatment group were evaluated (total=30 mice). Hepatocyte steatosis (micro- and macro-vesicular fatty change) was mostly limited to zones II/III in control mice; this degree of steatosis was arbitrarily assigned a grade (score) 2. Other samples were graded in a blinded manner (a grade 0 assigned to the lowest degree of steatosis observed). In addition, lipid-laden perisinusoidal cells, presumably stellate (Ito) cells, were observed in mice treated with either PEG-Compound 2 or Compound 170, but not Vehicle in which the Ito cells were obscured by hepatocyte steatosis. The abundance of the Ito cells was evaluated in a blinded manner (without counting) and each sample was arbitrarily graded to provide a semi-quantitative assessment (with a score of 3 indicating the highest abundance).

Figure 71A:
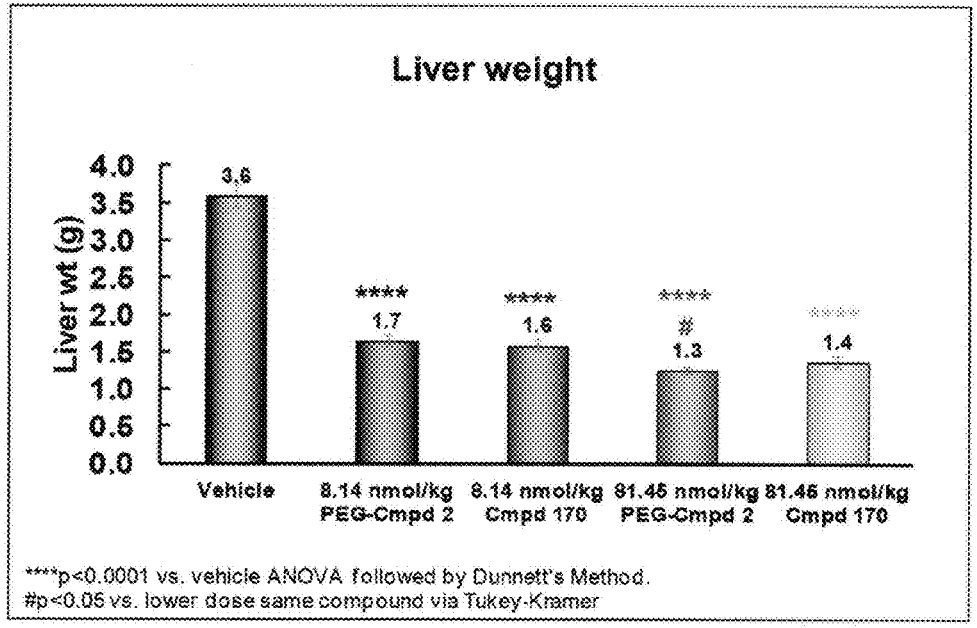

Both doses of both compounds significantly reduced fed glucose to normoglycemic levels (data not shown), and significantly reduced plasma insulin and HbA1c (data not shown). Significant increases in high molecular weight (HMW) adiponectin vs. vehicle were observed from Day 8 through Day 21, with a trend for dose-dependence, while plasma total adiponectin demonstrated some small, but inconsistent increases vs. vehicle (data not shown). Plasma NEFA and β-OH-butyrate both increased with both compounds (especially at the high dose) vs. vehicle (data not shown), suggesting increased fatty acid oxidation. Significant decreases in both absolute liver weight and liver weight corrected for body weight were observed on Day 21 in all treatment groups (FIGS. 71A and 71B). Specifically, in all four groups treated with FGF-21 variants, absolute liver weight was significantly decreased (p<0.0001) relative to vehicle control, and the higher dose of PEG-Compound 2 significantly decreased absolute liver weight relative to the lower dose of that compound (p<0.05) (FIG. 71A). Additionally, in all four groups treated with FGF-21 variants, the ratio of liver weight to body weight was significantly decreased (p<0.0001) relative to vehicle control (FIG. 71B). A dose-dependent reduction in the severity of hepatocyte steatosis was observed in mice treated with either PEG-Compound 2 or Compound 170 compared to vehicle (Table 31). Lipid-laden perisinusoidal cells (presumably Ito or hepatic stellate cells) were observed in sections from PEG-Compound 2 and Compound 170 treated mice (Table 32), but they could not be visualized in sections from Vehicle-treated mice due to interference from hepatocyte steatosis. A dose-dependent reduction in the severity of Ito cell prominence was observed in sections from mice treated with either PEG-Cmpd 2 or Compound 170.

TABLE 31

Hepatocyte steatosis (Fatty change) Incidence and Histology Scores in ob/ob mice

| | Vehicle | PEG-Cmpd 2 (8.14 nmol/kg) | Cmpd 170 (8.14 nmol/kg) | PEG-Cmpd 2 (81.45 nmol/kg) | Cmpd 170 (81.45 nmol/kg |
|---|---|---|---|---|---|
| | | | No. | | |
| Score | 6 | 6 | 6 | 6 | 6 |
| 0 | — | — | 1 | 6 | 6 |
| 1 | — | 6 | 5 | — | — |
| 2 | 6 | — | — | — | — |

TABLE 32

Perisinusoidal Lipid-laden Cell Incidence and Histology Scores in ob/ob mice.

| | Vehicle | PEG-Cmpd 2 (8.14 nmol/kg) | Cmpd 170 (8.14 nmol/kg) | PEG-Cmpd 2 (81.45 nmol/kg) | Cmpd 170 (81.45 nmol/kg |
|---|---|---|---|---|---|
| | | | No. | | |
| Score | 6 | 6 | 6 | 6 | 6 |
| 0 | ND | — | — | 1 | — |
| 1 | ND | — | 1 | 4 | 1 |
| 2 | ND | — | — | 1 | 5 |
| 3 | ND | 6 | 5 | — | — |

SEQUENCE LISTING (579 sequences)

SEQ ID NO: 1 - protein, 181 aa, Homo sapiens
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 2 - protein, 191 aa, Homo sapiens
MHHHHHHSGGHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 3 - protein, 209 aa, Homo sapiens [sequence omitted]

SEQ ID NO: 4 - protein, 208 aa, Homo sapiens
MDSDETGFEHSGLWVSVLAGLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 5 - protein, 181 aa, Homo sapiens
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 6 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 7 - protein, 208 aa, Homo sapiens
MDSDETGFEHSGLWVSVLAGLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 8 - DNA, 546 bp, Homo sapiens
caccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 9 - DNA, 576 bp, Homo sapiens
atgcatcatcatcatcatcatagcggcggccaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 10 - DNA, 630 bp, Homo sapiens
atggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 11 - DNA, 627 bp, Homo sapiens
atggactcggacgagaccgggttcgagcactcaggactgtgggtttctgtgctggctggtcttctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 12 - DNA, 545 bp, homo sapiens
caccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagcccagctacgcttcctga

SEQ ID NO: 13 - DNA, 630 bp, Homo sapiens
atggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctga

SEQ ID NO: 14 - DNA, 627 bp, Homo sapiens
atggactcggacgagaccgggttcgagcactcaggactgtgggtttctgtgctggctggtcttctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctga

SEQ ID NO: 15 - DNA, 77 bp, Artificial
  Mutant tRNA derived from Methanococcus jannaschii tRNA
ccggcggtagttcagcagggcagaacggcggactctaaatccgcatggcgctggttcaaatccagcccgccggacca

SEQ ID NO: 16 - protein, 306 aa, Artificial
  Mutant synthetase derived from Methanococcus jannaschii synthetase
MDEFEMIKRNTSEIISEEELREVLKKDEKSAVIGFEPSGKIHLGHYLQIKKMIDLQNAGFDIIIYLADLHAYLNQKGELDEIRKIGDYNKKVFEAMGLKAKYVYGSEHGLDKDYTLNVYRLALKTTLKRARRSMELIAREDENPKVAEVIYPIMQVNGIHYEGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 17 - DNA, 77 bp, Methanococcus jannaschii
ccggcggtagttcagcagggcagaacggcggactctaaatccgcatggcgctggttcaaatccggcccgccggacca

SEQ ID NO: 18 - DNA, 88 bp, Artificial
  An optimized amber supressor tRNA
cccagggtagccaagctcggccaacggcgacggactctaaatccgttctcgtaggagttcgagggttcgaatcccttccctgggacca

SEQ ID NO: 19 - DNA, 89 bp, Artificial
  An optimized AGGA frameshift supressor tRNA
gcgagggtagccaagctcggccaacggcgacggacttcctaatccgttctcgtaggagttcgagggttcgaatccctcccctcgcacca

SEQ ID NO: 20 - protein, 306 aa, Artificial
  Aminoacyl tRNA synthetase for the incorporation of p-azido-L-phenylalanine
MDEFEMIKRNTSEIISEEELREVLKKDEKSAGIGFEPSGKIHLGHYLQIKKMIDLQNAGFDIIILLADLHAYLNQKGELDEIRKIGDYNKKVFEAMGLKAKYVYGSTFQLDKDYTLNVYRLALKTTLKRARRSMELIAREDENPKVAEVIYPIMQVNTYYYLGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 21 - protein, 306 aa, Artificial
  Aminoacyl tRNA synthetase for the incorporation of p-benzoyl-L-phenylalanine
MDEFEMIKRNTSEIISEEELREVLKKDEKSAGIGFEPSGKIHLGHYLQIKKMIDLQNAGFDIIILLADLHAYLNQKGELDEIRKIGDYNKKVFEAMGLKAKYVYGSSFQLDKDYTLNVYRLALKTTLKRARRSMELIAREDENPKVAEVIYPIMQVNTSHYLGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 22 - protein, 305 aa, Artificial
  Aminoacyl tRNA synthetase for the incorporation of propargyl-phenylalanine
MDEFEMIKRNTSEIISEEELREVLKKDEKSAAIGFEPSGKIHLGHYLQIKKMIDLQNAGFDIIILLADLHAYLNQKGELDEIRKIGDYNKKVFEAMGLKAKYVYGSPFQLDKDYTLNVYRLALKTTLKRARRSMELIAREDENPKVAEVIYPIMQVNAIYLAVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 23 - protein, 305 aa, Artificial
  Aminoacyl tRNA synthetase for the incorporation of propargyl-phenylalanine
MDEFEMIKRNTSEIISEEELREVLKKDEKSAAIGFEPSGKIHLGHYLQIKKMIDLQNAGFDIIILLADLHAYLNQKGELDEIRKIGDYNKKVFEAMGLKAKYVYGSPFQLDKDYTLNVYRLALKTTLKRARRSMELIAREDENPKVAEVIYPIMQVNIPYLPVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 24 - protein, 305 aa, Artificial
  Aminoacyl tRNA synthetase for the incorporation of propargyl-phenylalanine
MDEFEMIKRNTSEIISEEELREVLKKDEKSAAIGFEPSGKIHLGHYLQIKKMIDLQNAGFDIIILLADLHAYLNQKGELDEIRKIGDYNKKVFEAMGLKAKYVYGSKFQLDKDYTLNVYRLALKTTLKRARRSMELIAREDENPKVAEVIYPIMQVNAIYLAVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 25 - protein, 306 aa, Artificial
  Aminoacyl tRNA synthetase  for the incorporation of p-azido-phenylalanine
MDEFEMIKRNTSEIISEEELREVLKKDEKSATIGFEPSGKIHLGHYLQIKKMIDLQNAGFDIIILLADLHAYLNQKGELDEIRKIGDYNKKVFEAMGLKAKYVYGSNFQLDKDYTLNVYRLALKTTLKRARRSMELIAREDENPKVAEVIYPIMQVNPLHYQGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 26 - protein, 306 aa, Artificial
  Aminoacyl tRNA synthetase  for the incorporation of p-azido-phenylalanine
MDEFEMIKRNTSEIISEEELREVLKKDEKSATIGFEPSGKIHLGHYLQIKKMIDLQNAGFDIIILLADLHAYLNQKGELDEIRKIGDYNKKVFEAMGLKAKYVYGSSFQLDKDYTLNVYRLALKTTLKRARRSMELIAREDENPKVAEVIYPIMQVNPLHYQGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 27 - protein, 306 aa, Artificial
  Aminoacyl tRNA synthetase for the incorporation of p-azido-phenylalanine
MDEFEMIKRNTSEIISEEELREVLKKDEKSALIGFEPSGKIHLGHYLQIKKMIDLQNAGFDIIILLADLHAYLNQKGELDEIRKIGDYNKKVFEAMGLKAKYVYGSTFQLDKDYTLNVYRLALKTTLKRARRSMELIAREDENPKVAEVIYPIMQVNPVHYQGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 28 - protein, 306 aa, Artificial
  Aminoacyl tRNA synthetase  for the incorporation of p-azido-phenylalanine
MDEFEMIKRNTSEIISEEELREVLKKDEKSATIGFEPSGKIHLGHYLQIKKMIDLQNAGFDIIILLADLHAYLNQKGELDEIRKIGDYNKKVFEAMGLKAKYVYGSSFQLDKDYTLNVYRLALKTTLKRARRSMELIAREDENPKVAEVIYPIMQVNPSHYQGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 29 - protein, 306 aa, Artificial
  Aminoacyl tRNA synthetase  for the incorporation of p-acetyl-phenylalanine
MDEFEMIKRNTSEIISEEELREVLKKDEKSALIGFEPSGKIHLGHYLQIKKMIDLQNAGFDIIILLADLHAYLNQKGELDEIRKIGDYNKKVFEAMGLKAKYVYGSEFQLDKDYTLNVYRLALKTTLKRARRSMELIAREDENPKVAEVIYPIMQVNGCHYRGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 30 - protein, 306 aa, Artificial
  Aminoacyl tRNA synthetase  for the incorporation of p-acetyl -phenylalanine
MDEFEMIKRNTSEIISEEELREVLKKDEKSALIGFEPSGKIHLGHYLQIKKMIDLQNAGFDIIILLADLHAYLNQKGELDEIRKIGDYNKKVFEAMGLKAKYVYGSEFQLDKDYTLNVYRLALKTTLKRARRSMELIAREDENPKVAEVIYPIMQVNGTHYRGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 31 - protein, 306 aa, Artificial
  Aminoacyl tRNA synthetase  for the incorporation of p-acetyl-phenylalanine
MDEFEMIKRNTSEIISEEELREVLKKDEKSAAIGFEPSGKIHLGHYLQIKKMIDLQNAGFDIIILLADLHAYLNQKGELDEIRKIGDYNKKVFEAMGLKAKYVYGSEFQLDKDYTLNVYRLALKTTLKRARRSMELIAREDENPKVAEVIYPIMQVNGGHYLGVDVIVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 32 - protein, 306 aa, Artificial
  Aminoacyl tRNA synthetase  for the incorporation of p-azido-phenylalanine
MDEFEMIKRNTSEIISEEELREVLKKDEKSAAIGFEPSGKIHLGHYLQIKKMIDLQNAGFDIIILLADLHAYLNQKGELDEIRKIGDYNKKVFEAMGLKAKYVYGSRFQLDKDYTLNVYRLALKTTLKRARRSMELIAREDENPKVAEVIYPIMQVNVIHYDGVDVAVGGMEQRKIHMLARELLPKKVVCIHNPVLTGLDGEGKMSSSKGNFIAVDDSPEEIRAKIKKAYCPAGVVEGNPIMEIAKYFLEYPLTIKRPEKFGGDLTVNSYEELESLFKNKELHPMDLKNAVAEELIKILEPIRKRL

SEQ ID NO: 33 - protein, 306 aa, Artificial; identical to SEQ ID NO: 20
  Aminoacyl tRNA synthetase  for the incorporation of p-azido-phenylalanine

SEQ ID NO: 34 - protein, 208 aa, Rattus norvegicus
MDWMKSRVGAPGLWVCLLLPVFLLGVCEAYPISDSSPLLQFGGQVRQRYLYTDDDQDTEAHLEIREDGTVVGTAHRSPESLLELKALKPGVIQILGVKASRFLCQQPDGTLYGSPHFDPEACSFRELLLKDGYNVYQSEAHGLPLRLPQKDSQDPATRGPVRFLPMPGLPHEPQEQPGVLPPEPPDVGSSDPLSMVEPLQGRSPSYAS

SEQ ID NO: 35 - protein, 210 aa, Mus musculus
MEWMRSRVGTLGLWVRLLLAVFLLGVYQAYPIPDSSPLLQFGGQVRQRYLYTDDDQDTEAHLEIREDGTVVGAAHRSPESLLELKALKPGVIQILGVKASRFLCQQPDGALYGSPHFDPEACSFRELLLEDGYNVYQSEAHGLPLRLPQKDSPNQDATSWGPVRFLPMPGLLHEPQDQAGFLPPEPPDVGSSDPLSMVEPLQGRSPSYAS

SEQ ID NO: 36 - protein, 194 aa, Danio rerio
MLFACFFIFFALFPHLRWCMYVPAQNVLLQFGTQVRERLLYTDGLFLEMNPDGSVKGSPEKNLNCVLELRSVKAGETVIQSAATSLYLCVDDQDKLKGQHHYSALDCTFQELLLDGYSFFLSPHTNLPVSLLSKRQKHGNPLSRFLPVSRAEDSRTQEVKQYIQDINLDSDDPLGMGHRSHLQTVFSPSLHTKK

SEQ ID NO: 37 - protein, 1043 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 38 - protein, 1043 aa, Mus musculus
MKTGCAAGSPGNEWIFFSSDERNTRSRKTMSNRALQRSAVLSAFVLLRAVTGFSGDGKAIWDKKQYVSPVNPSQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGLPAENRSPACGQPAEDTDCTICSFLVEKKPLIFFGCCFISTLAVLLSITVFHHQKRRKFQKARNLQNIPLKKGHSRVFS

SEQ ID NO: 39 - DNA, 63 bp, Artificial
  FGF21 secretion constructs, cloned into pVK7ara (Nde/Eco)
atgaaaaaaactgctatcgcgatcgctgtagctctggctggtttcgcgaccgtagctaacgct

SEQ ID NO: 40 - protein, 21 aa, Artificial
  FGF21 secretion constructs, cloned into pVK7ara (Nde/Eco)
MKKTAIAIAVALAGFATVANA

SEQ ID NO: 41 - DNA, 78 bp, Artificial
  FGF21 secretion constructs, cloned into pVK7ara (Nde/Eco)
atgaaaataaaaacaggtgcacgcatcctcgcattatccgcattaacgacgatgatgttttccgcctcggctctcgcc

SEQ ID NO: 42 - protein, 26 aa, Artificial
  FGF21 secretion constructs, cloned into pVK7ara (Nde/Eco)
MKIKTGARILALSALTTMMFSASALA

SEQ ID NO: 43 - DNA, 69 bp, Artificial
  FGF21 secretion constructs, cloned into pVK7ara (Nde/Eco)
atgaaaaagaatatcgcatttcttcttgcatctatgttcgttttttctattgctacaaatgcctatgca

SEQ ID NO: 44 - protein, 23 aa, Artificial
  FGF21 secretion constructs, cloned into pVK7ara (Nde/Eco)
MKKNIAFLLASMFVFSIATNAYA

SEQ ID NO: 45 - protein, 8 aa, Artificial Sequence
  Synthetic peptide
HSYYEQNS

SEQ ID NO: 46 - protein, 4 aa, Artificial Sequence
  Synthetic peptide
YSQT

SEQ ID NO: 47 - protein, 7 aa, Artificial Sequence
  Synthetic peptide
YGSKYYY

SEQ ID NO: 48 - protein, 86 aa, Artificial Sequence
  Synthetic polypeptide
EVVAATPTSLLISWPKYDKTGHYYRITYGETGGNSPVQEFTVPTRQTTATISGLKPGVDYTITVYAVSKDDYYPHEHRPISINYRT

SEQ ID NO: 49 - protein, 86 aa, Artificial Sequence
  Synthetic polypeptide
EVVAATPTSLLISWSNDGPGLSYYRITYGETGGNSPVQEFTVPSSQTTATISGLKPGVDYTITVYAVSYYTKKAYSAGPISINYRT

SEQ ID NO: 50 - protein, 86 aa, Artificial Sequence
  Synthetic polypeptide
EMVAATPTSLLISWEDDSYYSRYYRITYGETGGNSPVQEFTVPSDLYTATISGLKPGVDYTITVYAVTYDVTDLIMHEPISINYRT

SEQ ID NO: 51 - protein, 86 aa, Artificial Sequence
  Synthetic polypeptide
EVVAATPTSLLISWEDDSYYSRYYRITYGETGGNSPVQEFTVPSDLYTATISGLKPGVDYTITVYAVTYDVTDLIMHEPISINYRT

SEQ ID NO: 52 - protein, 86 aa, Artificial Sequence
  Synthetic polypeptide
EVVAATPTSLLISWYMDEYDVRYYRITYGETGGNSPVQEFTVPNYYNTATISGLKPGVDYTITVYAVTRIKANNYMYGPISINYRT

SEQ ID NO: 53 - protein, 86 aa, Artificial Sequence
  Synthetic polypeptide
EVVAATPTSLLISWNHLEHVARYYRITYGETGGNSPVQEFTVPEYPTTATISGLKPGVDYTITVYAVTITMLKYPTQSPISINYRT

SEQ ID NO: 54 - protein, 86 aa, Artificial Sequence
  Synthetic polypeptide
EVVAATPTSLLISWGHYRRSGHYYRITYGETGGNSPVQEFTVDPSSYTATISGLKPGVDYTITVYAVSKDDYYPHEHRPISINYRT

SEQ ID NO: 55 - protein, 84 aa, Artificial Sequence
  Synthetic polypeptide
EVVAATPTSLLISWDASHYERRYYRITYGETGGNSPVQEFTVPRYHHTATISGLKPGVDYTITVYAVTQAQEHYQPPISINYRT

SEQ ID NO: 56 - protein, 82 aa, Artificial Sequence
  Synthetic polypeptide
EVVAATPTSLLISWNSYYHSADYYRITYGETGGNSPVQEFTVPYPPTTATISGLKPGVDYTITVYAVYSAKSYYPISINYRT

SEQ ID NO: 57 - protein, 86 aa, Artificial Sequence
  Synthetic polypeptide
EVVAATPTSLLISWSKYSKHGHYYRITYGETGGNSPVQEFTVPSGNATATISGLKPGVDYTITVYAVEDTNDYPHTHRPISINYRT

SEQ ID NO: 58 - protein, 84 aa, Artificial Sequence
  Synthetic polypeptide
EVVAATPTSLLISWHGEPDQTRYYRITYGETGGNSPVQEFTVPPYRRTATISGLKPGVDYTITVYAVTSGYTGHYQPISINYRT

SEQ ID NO: 59 - protein, 86 aa, Artificial Sequence
  Synthetic polypeptide
EVVAATPTSLLISWSKYSKHGHYYRITYGETGGNSPVQEFTVDPSSYTATISGLKPGVDYTITVYAVSKDDYYPHEHRPISINYRT

SEQ ID NO: 60 - protein, 82 aa, Artificial Sequence
  Synthetic polypeptide
EVVAATPTSLLISWYEPYTPIHYYRITYGETGGNSPVQEFTVPGYYGTATISGLKPGVDYTITVYAVYGYYQYTPISINYRT

SEQ ID NO: 61 - protein, 86 aa, Artificial Sequence
  Synthetic polypeptide
EVVAATPTSLLISWSKYSKHGHYYRITYGETGGNSPVQEFTVPSGNATATISGLKPGVDYTITVYAVSDDNKYYHQHRPISINYRT

SEQ ID NO: 62 - protein, 86 aa, Artificial Sequence; identical to SEQ ID NO: 54
  Synthetic polypeptide

SEQ ID NO: 63 - protein, 86 aa, Artificial Sequence; identical to SEQ ID NO: 57
  Synthetic polypeptide

SEQ ID NO: 64 - protein, 82 aa, Artificial Sequence
  Synthetic polypeptide
EVVAATPTSLLISWYEPGASVYYYRITYGETGGNSPVQEFTVPSYYHTATISGLKPGVDYTITVYAVYGYYEYEPISINYRT

SEQ ID NO: 65 - protein, 82 aa, Artificial Sequence
  Synthetic polypeptide
EVVAATPTSLLISWQSYYAHSDYYRITYGETGGNSPVQEFTVPYPPQTATISGLKPGVDYTITVYAVYAGSSYYPISINYRT

SEQ ID NO: 66 - protein, 86 aa, Artificial Sequence; identical to SEQ ID NO: 54
  Synthetic polypeptide

SEQ ID NO: 67 - protein, 82 aa, Artificial Sequence
  Synthetic polypeptide
EVVAATPTSLLISWPEPGTPVYYYRITYGETGGNSPVQEFTVPAYYGTATISGLKPGVDYTITVYAVYGYYDYSPISINYRT

SEQ ID NO: 68 - protein, 86 aa, Artificial Sequence
  Synthetic polypeptide
EVVAATPTSLLISWYRYEKTQHYYRITYGETGGNSPVQEFTVPPESGTATISGLKPGVDYTITVYAVYAGYEYPHTHRPISINYRT

SEQ ID NO: 69 - protein, 87 aa, Artificial Sequence
  Synthetic polypeptide
EVVAATPTSLLISWVKSEEYYRYYRITYGETGGNSPVQEFTVPYYVHTATISGLKPGVDYTITVYAVTEYYYAGAVVSVPISINYRT

SEQ ID NO: 70 - protein, 82 aa, Artificial Sequence
  Synthetic polypeptide
EVVAATPTSLLISWYDPYTYGSYYRITYGETGGNSPVQEFTVGPYTTTATISGLKPGVDYTITVYAVSYYYSTQPISINYRT

SEQ ID NO: 71 - protein, 86 aa, Artificial Sequence; identical to SEQ ID NO: 49
  Synthetic polypeptide

SEQ ID NO: 72 - protein, 82 aa, Artificial Sequence
  Synthetic polypeptide
EVVAATPTSLLISWPDPYYKPDYYRITYGETGGNSPVQEFTVPRDYTTATISGLKPGVDYTITVYAVYSYYGYYPISINYRT

SEQ ID NO: 73 - protein, 12 aa, Artificial
  Synthetic sequence
PGNKSPHRDPAP

SEQ ID NO: 74 - protein, 8 aa, Artificial
  Synthetic sequence
GAGGGGSG

SEQ ID NO: 75 - protein, 6 aa, Artificial
  Synthetic sequence
EPKSSD

SEQ ID NO: 76 - protein, 21 aa, Artificial
  Synthetic sequence
ESPKAQASSVPTAQPQAEGLA

SEQ ID NO: 77 - protein, 17 aa, Artificial
  Synthetic sequence
ELQLEESAAEAQDGELD

SEQ ID NO: 78 - protein, 9 aa, Artificial
  Synthetic sequence
GQPDEPGGS

SEQ ID NO: 79 - protein, 13 aa, Artificial
  Synthetic sequence
GGSGSGSGSGSGS

SEQ ID NO: 80 - protein, 17 aa, Artificial
  Synthetic sequence
ELQLEESAAEAQEGELE

SEQ ID NO: 81 - protein, 5 aa, Artificial
  Synthetic sequence
GSGSG

SEQ ID NO: 82 - protein, 4 aa, Artificial
  Synthetic sequence
GSGC

SEQ ID NO: 83 - protein, 7 aa, Artificial
  Synthetic sequence
AGGGGSG

SEQ ID NO: 84 - protein, 4 aa, Artificial
  Synthetic sequence
GSGS

SEQ ID NO: 85 - protein, 8 aa, Artificial
  Synthetic sequence
QPDEPGGS

SEQ ID NO: 86 - protein, 6 aa, Artificial
  Synthetic sequence
GSGSGS

SEQ ID NO: 87 - protein, 6 aa, Artificial
  Synthetic sequence
TVAAPS

SEQ ID NO: 88 - protein, 8 aa, Artificial
  Synthetic sequence
KAGGGGSG

SEQ ID NO: 89 - protein, 13 aa, Artificial
  Synthetic sequence
KGSGSGSGSGSGS

SEQ ID NO: 90 - protein, 9 aa, Artificial
  Synthetic sequence
KQPDEPGGS

SEQ ID NO: 91 - protein, 18 aa, Artificial
  Synthetic sequence
KELQLEESAAEAQDGELD

SEQ ID NO: 92 - protein, 7 aa, Artificial
  Synthetic sequence
KTVAAPS

SEQ ID NO: 93 - protein, 9 aa, Artificial
  Synthetic sequence
KAGGGGSGG

SEQ ID NO: 94 - protein, 14 aa, Artificial
  Synthetic sequence
KGSGSGSGSGSGSG

SEQ ID NO: 95 - protein, 10 aa, Artificial
  Synthetic sequence
KQPDEPGGSG

SEQ ID NO: 96 - protein, 19 aa, Artificial
  Synthetic sequence
KELQLEESAAEAQDGELDG

SEQ ID NO: 97 - protein, 16 aa, Artificial
  Synthetic sequence
KTVAAPSGAGGGGSGG

SEQ ID NO: 98 - protein, 7 aa, Artificial
  Synthetic sequence
AGGGGSG

SEQ ID NO: 99 - protein, 13 aa, Artificial
  Synthetic sequence
GSGSGSGSGSGSG

SEQ ID NO: 100 - protein, 9 aa, Artificial
  Synthetic sequence
QPDEPGGSG

SEQ ID NO: 101 - protein, 182 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 102 - protein, 173 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 103 - protein, 182 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVEPSQGRSPSYAS

SEQ ID NO: 104 - protein, 182 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGKKSPHRDPAPRGPARFLPLPGLPPAPPEPPGILAPQPPDVGSSDPLSMVEPSQGRSPSYAS

SEQ ID NO: 105 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGDKSRDPAPRGPARFLPLPGLPPAPPEPPGILAPQPPDVGSSDPLSMVEPSQGRSPSYAS

SEQ ID NO: 106 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGHKSRDPAPRGPARFLPLPGLPPAPPEPPGILAPQPPDVGSSDPLSMVEPSQGRSPSYAS

SEQ ID NO: 107 - protein, 182 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGDKSPHRDPAPRGPARFLPLPGLPPAPPEPPGILAPQPPDVGSSDPLSMVEPSQGRSPSYAS

SEQ ID NO: 108 - protein, 170 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGARFLPLPGLPPAPPEPPGILAPQPPDVGSSDPLSMVEPSQGRSPSYAS

SEQ ID NO: 109 - protein, 182 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGQKSPHRDPAPRGPARFLPLPGLPPAPPEPPGILAPQPPDVGSSDPLSMVEPSQGRSPSYAS

SEQ ID NO: 110 - protein, 172 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGGPARFLPLPGLPPAPPEPPGILAPQPPDVGSSDPLSMVEPSQGRSPSYAS

SEQ ID NO: 111 - protein, 179 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGHRDPAPRGPARFLPLPGLPPAPPEPPGILAPQPPDVGSSDPLSMVEPSQGRSPSYAS

SEQ ID NO: 112 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPHHSGRDPAPRGPARFLPLPGLPPAPPEPPGILAPQPPDVGSSDPLSMVEPSQGRSPSYAS

SEQ ID NO: 113 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGKDSQDPAPRGPARFLPLPGLPPAPPEPPGILAPQPPDVGSSDPLSMVEPSQGRSPSYAS

SEQ ID NO: 114 - protein, 181 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGHHKSRDPAPRGPARFLPLPGLPPAPPEPPGILAPQPPDVGSSDPLSMVGPSQGRSPSYAS

SEQ ID NO: 115 - protein, 181 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGHHKSRDPAPRGPARFLPLPGLPPAPPEPPGILAPQPPDVGSSDPLSMVEPSQGREPSYAS

SEQ ID NO: 116 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGHHKSRDPAPRGPARFLPLPGLPPAPPEPPGILAPQPPDVGSSDPLSMVPSQGRSPSYAS

SEQ ID NO: 117 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGHHKSRDPAPRGPARFLPLPGLPPAPPEPPGILAPQPPDVGSSDPLSMVGSQGRSPSYAS

SEQ ID NO: 118 - protein, 172 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVEP

SEQ ID NO: 119 - protein, 180 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGPHRDPAPRGPARFLPLPGLPPAPPEPPGILAPQPPDVGSSDPLSMVEPSQGRSPSYAS

SEQ ID NO: 120 - protein, 178 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGGHRDPAPRGPARFLPLPGLPPAPPEPPGILAPQPPDVGSSDPLSMVEPSQGRSPSYAS

SEQ ID NO: 121 - protein, 178 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRDPAPRGPARFLPLPGLPPAPPEPPGILAPQPPDVGSSDPLSMVEPSQGRSPSYAS

SEQ ID NO: 122 - protein, 176 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLSGGPAPRGPARFLPLPGLPPAPPEPPGILAPQPPDVGSSDPLSMVEPSQGRSPSYAS

SEQ ID NO: 123 - protein, 171 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGGGPARFLPLPGLPPAPPEPPGILAPQPPDVGSSDPLSMVEPSQGRSPSYAS

SEQ ID NO: 124 - protein, 169 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGGRFLPLPGLPPAPPEPPGILAPQPPDVGSSDPLSMVEPSQGRSPSYAS

SEQ ID NO: 125 - protein, 170 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPSGGRFLPLPGLPPAPPEPPGILAPQPPDVGSSDPLSMVEPSQGRSPSYAS

SEQ ID NO: 126 - protein, 175 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHSGGPAPRGPARFLPLPGLPPAPPEPPGILAPQPPDVGSSDPLSMVEPSQGRSPSYAS

SEQ ID NO: 127 - protein, 171 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHGSGGPARFLPLPGLPPAPPEPPGILAPQPPDVGSSDPLSMVEPSQGRSPSYAS

SEQ ID NO: 128 - protein, 166 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPHGGRFLPLPGLPPAPPEPPGILAPQPPDVGSSDPLSMVEPSQGRSPSYAS

SEQ ID NO: 129 - protein, 167 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPHSGGRFLPLPGLPPAPPEPPGILAPQPPDVGSSDPLSMVEPSQGRSPSYAS

SEQ ID NO: 130 - protein, 167 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPHGSGRFLPLPGLPPAPPEPPGILAPQPPDVGSSDPLSMVEPSQGRSPSYAS

SEQ ID NO: 131 - protein, 172 aa, Artificial
  Synthetic sequence
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGGPARFLPLPGLPPAPPEPPGILAPQPPDVGSSDPLSMVTPSQGRSPSYAS

SEQ ID NO: 132 - protein, 187 aa, Artificial
  Synthetic sequence
MHHHHHHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 133-200 - skipped (68 entries)

SEQ ID NO: 201 - protein, 182 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLPGNKSPHRDPAPRGPARFLPLPGLPPAPPEPPGILAPQPPDVGSSDPLSMVGPSQGRSPSYAS

SEQ ID NO: 202 - protein, 173 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGSGRGPARFLPLPGLPPAPPEPPGILAPQPPDVGSSDPLSMVEPSQGRSPSYAS

SEQ ID NO: 203-204 - skipped (2 entries)

SEQ ID NO: 205 - protein, 180 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLPGDKSRDPAPRGPARFLPLPGLPPAPPEPPGILAPQPPDVGSSDPLSMVEPSQGRSPSYAS

SEQ ID NO: 206 - protein, 180 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLPGHKSRDPAPRGPARFLPLPGLPPAPPEPPGILAPQPPDVGSSDPLSMVEPSQGRSPSYAS

SEQ ID NO: 207-209 - skipped (3 entries)

SEQ ID NO: 210 - protein, 172 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGSGGPARFLPLPGLPPAPPEPPGILAPQPPDVGSSDPLSMVEPSQGRSPSYAS

SEQ ID NO: 211 - protein, 179 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGSGHRDPAPRGPARFLPLPGLPPAPPEPPGILAPQPPDVGSSDPLSMVEPSQGRSPSYAS

SEQ ID NO: 212 - protein, 180 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLPHHSGRDPAPRGPARFLPLPGLPPAPPEPPGILAPQPPDVGSSDPLSMVEPSQGRSPSYAS

SEQ ID NO: 213-218 - skipped (6 entries)

SEQ ID NO: 219 - protein, 180 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGSGPHRDPAPRGPARFLPLPGLPPAPPEPPGILAPQPPDVGSSDPLSMVEPSQGRSPSYAS

SEQ ID NO: 220 - protein, 178 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGGHRDPAPRGPARFLPLPGLPPAPPEPPGILAPQPPDVGSSDPLSMVEPSQGRSPSYAS

SEQ ID NO: 221 - protein, 178 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGSGRDPAPRGPARFLPLPGLPPAPPEPPGILAPQPPDVGSSDPLSMVEPSQGRSPSYAS

SEQ ID NO: 222 - protein, 176 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLSGGPAPRGPARFLPLPGLPPAPPEPPGILAPQPPDVGSSDPLSMVEPSQGRSPSYAS

SEQ ID NO: 223 - protein, 171 aa, Artificial
  Synthetic sequence
  misc_feature (109)..(109): Para-acetyl-L-phenylalanine optionally linked to a 30 kDa poly(ethylene glycol)
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYXSEAHGLPLHLGGGPARFLPLPGLPPAPPEPPGILAPQPPDVGSSDPLSMVEPSQGRSPSYAS

SEQ ID NO: 224-300 - skipped (77 entries)

SEQ ID NO: 301 - protein, 7 aa, Artificial
  Synthetic sequence
TVAAPSG

SEQ ID NO: 302 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 16 aa, Artificial
  Synthetic sequence
DKTHTCPPCPAPELLG

SEQ ID NO: 304 - protein, 16 aa, Artificial
  Synthetic sequence
GSTHTCPPCPAPELLG

SEQ ID NO: 305 - protein, 24 aa, Artificial
  Synthetic sequence
EPKSSDKTHTCPPCPAPELLGGPS

SEQ ID NO: 306 - protein, 24 aa, Artificial
  Synthetic sequence
EPKSSDKTHTCPPCPAPELLGGSS

SEQ ID NO: 307 - protein, 24 aa, Artificial
  Synthetic sequence
EPKSSGSTHTCPPCPAPELLGGSS

SEQ ID NO: 308 - protein, 19 aa, Artificial
  Synthetic sequence
DKTHTCPPCPAPELLGGPS

SEQ ID NO: 309 - protein, 19 aa, Artificial
  Synthetic sequence
DKTHTCPPCPAPELLGGSS

SEQ ID NO: 310 - protein, 20 aa, Artificial
  Synthetic sequence
ASPAAPAPASPAAPAPSAPA

SEQ ID NO: 311 - protein, 20 aa, Artificial
  Synthetic sequence
AAPASPAPAAPSAPAPAAPS

SEQ ID NO: 312 - protein, 20 aa, Artificial
  Synthetic sequence
APSSPSPSAPSSPSPASPSS

SEQ ID NO: 313 - protein, 20 aa, Artificial
  Synthetic sequence
SAPSSPSPSAPSSPSPASPS

SEQ ID NO: 314 - protein, 20 aa, Artificial
  Synthetic sequence
SSPSAPSPSSPASPSPSSPA

SEQ ID NO: 315 - protein, 24 aa, Artificial
  Synthetic sequence
AASPAAPSAPPAAASPAAPSAPPA

SEQ ID NO: 316 - protein, 20 aa, Artificial
  Synthetic sequence
ASAAAPAAASAAASAPSAAA

SEQ ID NO: 317 - DNA, 519 bp, Artificial
  Synthetic sequence
atgcatcctattcctgattcttctcctctgctgcaatttgggggtcaggtgcgccaacgttacctgtacaccgacgatgcgcaacagactgaggctcacctggagatccgtgaggacgggactgtcggaggggctgccgatcaatccccagagtcactgctgcaactgaaagccctgaagcctggggtcattcagatcctgggcgtaaagacgagtcgtttcctgtgccaacgtcctgacggggcactgtatggctcgctgcattttgatcctgaggcttgtagttttcgcgaactgctgctggaagatggttacaatgtgtatcagagtgaagcacacggtctgcctctgcacctgggttctggtcgtggtccggcgcgttttctgccactgcctggcctgcctccagcaccacctgaaccaccgggtattctggctccgcaacctccagacgtcgggagttcagatcctctgtcgatggtagaaccgtcacaaggtcgctctcctagttacgcgtca

SEQ ID NO: 318 - DNA, 519 bp, Artificial
  Synthetic sequence
atgcatcctattcctgattcttctcctctgctgcaatttgggggtcaggtgcgccaacgttacctgtacaccgacgatgcgcaacagactgaggctcacctggagatccgtgaggacgggactgtcggaggggctgccgatcaatccccagagtcactgctgcaactgaaagccctgaagcctggggtcattcagatcctgggcgtaaagacgagtcgtttcctgtgccaacgtcctgacggggcactgtatggctcgctgcattttgatcctgaggcttgtagttttcgcgaactgctgctggaagatggttacaatgtgtattagagtgaagcacacggtctgcctctgcatctgggctccggccgcggtccggcccgttttctgccactgcctggcctgcctccagcaccacctgaaccaccgggtattctggctccgcaacctccagacgtcgggagttcagatcctctgtcgatggtagaaccgtcacaaggtcgctctcctagttacgcgtca

SEQ ID NO: 319 - protein, 98 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQ

SEQ ID NO: 320 - protein, 103 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTP

SEQ ID NO: 321 - protein, 585 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 322 - protein, 584 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALG

SEQ ID NO: 323 - protein, 227 aa, Artificial; identical to SEQ ID NO: 302
  Synthetic sequence

SEQ ID NO: 324 - protein, 225 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 325 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - protein, 227 aa, Artificial
  Synthetic sequence
DKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 232 aa, Artificial
  Synthetic sequence
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - protein, 226 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 330 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYSSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 332 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - protein, 227 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYHSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - protein, 233 aa, Artificial
  Synthetic sequence
DKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 335 - protein, 233 aa, Artificial
  Synthetic sequence
DKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 336-342 - skipped (7 entries)

SEQ ID NO: 343 - protein, 4 aa, Artificial
  Synthetic sequence
GSGH

SEQ ID NO: 344 - protein, 4 aa, Artificial
  Synthetic sequence
HHSG

SEQ ID NO: 345 - protein, 4 aa, Artificial
  Synthetic sequence
HGSH

SEQ ID NO: 346 - protein, 4 aa, Artificial
  Synthetic sequence
GSGP

SEQ ID NO: 347 - protein, 4 aa, Artificial
  Synthetic sequence
HSGG

SEQ ID NO: 348 - protein, 4 aa, Artificial
  Synthetic sequence
HGSG

SEQ ID NO: 349 - protein, 4 aa, Artificial
  Synthetic sequence
KDSQ

SEQ ID NO: 350 - protein, 28 aa, Artificial
  Synthetic sequence
GGGGSGGGSGGGGGSGGGSGGGGSGGGS

SEQ ID NO: 351 - protein, 15 aa, Artificial
  Synthetic sequence
PSPEPPTPEPPSPEP

SEQ ID NO: 352 - protein, 17 aa, Artificial
  Synthetic sequence
ELQLEESAAEAQEGELE

SEQ ID NO: 353 - protein, 17 aa, Artificial
  Synthetic sequence
SSGGGGSGGGSGGGGGS

SEQ ID NO: 354 - protein, 2 aa, Artificial
  Synthetic sequence
GS

SEQ ID NO: 355 - protein, 5 aa, Artificial
  Synthetic sequence
GGGGS

SEQ ID NO: 356 - protein, 10 aa, Artificial
  Synthetic sequence
EEEEDEEEED

SEQ ID NO: 357 - protein, 10 aa, Artificial
  Synthetic sequence
PSPEPPTPEP

SEQ ID NO: 358 - protein, 12 aa, Artificial
  Synthetic sequence
GSHHHHHHHHGS

SEQ ID NO: 359 - protein, 15 aa, Artificial
  Synthetic sequence
GGGGSGGGGSGGGGS

SEQ ID NO: 360 - protein, 15 aa, Artificial
  Synthetic sequence
GGGGGSGGGSGGGGS

SEQ ID NO: 361 - protein, 16 aa, Artificial
  Synthetic sequence
GSGSGSGSGSGSGSGS

SEQ ID NO: 362 - protein, 18 aa, Artificial
  Synthetic sequence
PSTPPTPSPSTPPTPSPS

SEQ ID NO: 363 - protein, 23 aa, Artificial
  Synthetic sequence
RGGEEKKKEKEKEEQEERETKTP

SEQ ID NO: 364 - protein, 25 aa, Artificial
  Synthetic sequence
GGGGSGGGGSGGGGSGGGGSGGGGS

SEQ ID NO: 365 - protein, 30 aa, Artificial
  Synthetic sequence
PSPEPPTPEPPSPEPPTPEPPSPEPPTPEP

SEQ ID NO: 366 - protein, 36 aa, Artificial
  Synthetic sequence
PSTPPTPSPSTPPTPSPSPSTPPTPSPSTPPTPSPS

SEQ ID NO: 367 - protein, 5 aa, Artificial
  Synthetic sequence
PSPEP

SEQ ID NO: 368 - protein, 20 aa, Artificial
  Synthetic sequence
PSPEPPTPEPPSPEPPTPEP

SEQ ID NO: 369 - protein, 40 aa, Artificial
  Synthetic sequence
PSPEPPTPEPPSPEPPTPEPPSPEPPTPEPPSPEPPTPEP

SEQ ID NO: 370 - protein, 20 aa, Artificial
  Synthetic sequence
PTPEPPSPEPPTPEPPSPEP

SEQ ID NO: 371 - protein, 14 aa, Artificial
  Synthetic sequence
PSPEPGGGSPTPEP

SEQ ID NO: 372 - protein, 14 aa, Artificial
  Synthetic sequence
PSPEPEEEDPTPEP

SEQ ID NO: 373 - protein, 24 aa, Artificial
  Synthetic sequence
PSPEPPTPEPEEEDPSPEPPTPEP

SEQ ID NO: 374 - protein, 34 aa, Artificial
  Synthetic sequence
PTPEPPSPEPPTPEPEEEDPSPEPPTPEPPSPEP

SEQ ID NO: 375 - protein, 35 aa, Artificial
  Synthetic sequence
PTPEPPSPEPPTPEPGGGGSPSPEPPTPEPPSPEP

SEQ ID NO: 376 - protein, 26 aa, Artificial
  Synthetic sequence
PSPEPTPEPSPEPPTPEPSPEPTPEP

SEQ ID NO: 377 - protein, 5 aa, Artificial
  Synthetic sequence
GETGS

SEQ ID NO: 378 - protein, 10 aa, Artificial
  Synthetic sequence
GGGGSGGGGS

SEQ ID NO: 379 - protein, 10 aa, Artificial
  Synthetic sequence
GETGSSGEGT

SEQ ID NO: 380 - protein, 15 aa, Artificial
  Synthetic sequence
GETGSSGEGTGSTGS

SEQ ID NO: 381 - protein, 20 aa, Artificial
  Synthetic sequence
GGGGSGGGGSGGGGSGGGGS

SEQ ID NO: 382 - protein, 20 aa, Artificial
  Synthetic sequence
GETGSSGEGTGSTGSGAGES

SEQ ID NO: 383 - protein, 30 aa, Artificial
  Synthetic sequence
GETGSSGEGTGSTGSGAGESGTGESGEGGS

SEQ ID NO: 384-400 - skipped (17 entries)

SEQ ID NO: 401 - protein, 277 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 402 - protein, 280 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 403 - protein, 285 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPEEEEDEEEEDHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 404 - protein, 285 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 405 - protein, 287 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGSHHHHHHHHGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 406 - protein, 290 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 407 - protein, 290 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 408 - protein, 291 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGSGSGSGSGSGSGSGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 409 - protein, 293 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSTPPTPSPSTPPTPSPSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 410 - protein, 298 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPRGGEEKKKEKEKEEQEERETKTPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 411 - protein, 300 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPGGGGSGGGGSGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 412 - protein, 305 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPPTPEPPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 413 - protein, 311 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSTPPTPSPSTPPTPSPSPSTPPTPSPSTPPTPSPSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 414 - protein, 280 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 415 - protein, 295 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 416 - protein, 315 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPPTPEPPSPEPPTPEPPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 417 - protein, 295 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPTPEPPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 418 - protein, 289 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPGGGSPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 419 - protein, 289 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPEEEDPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 420 - protein, 299 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPPTPEPEEEDPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 421 - protein, 309 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPTPEPPSPEPPTPEPEEEDPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 422 - protein, 310 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPTPEPPSPEPPTPEPGGGGSPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 423 - protein, 301 aa, Artificial
  Synthetic sequence
GVSDVPRDLEVVAATPTSLLISWDAPAVTVRYYRITYGREVQKYSDLGPLYIYQEFTVPGSKSTATISGLKPGVDYTITVYAVTGSGESPASSKPISINYRTPPSPEPTPEPSPEPPTPEPSPEPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 424 - protein, 759 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 425 - protein, 762 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 426 - protein, 762 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGETGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 427 - protein, 767 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 428 - protein, 767 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGETGSSGEGTHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 429 - protein, 772 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 430 - protein, 772 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGETGSSGEGTGSTGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 431 - protein, 777 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 432 - protein, 777 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGETGSSGEGTGSTGSGAGESHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 433 - skipped

SEQ ID NO: 434 - protein, 771 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 435 - protein, 771 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGGETGSSGEGTGSTGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 436 - protein, 780 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 437 - protein, 780 aa, Artificial
  Synthetic sequence
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGGETGSSGEGTGSTGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 438-439 - skipped (2 entries)

SEQ ID NO: 440 - protein, 767 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYASGETGSSGEGTDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 441 - protein, 777 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYASGETGSSGEGTGSTGSGAGESDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 442 - protein, 787 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYASGETGSSGEGTGSTGSGAGESGTGESGEGGSDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 443 - protein, 786 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYASGETGSSGEGTGSTGSGAGESDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 444-445 - skipped (2 entries)

SEQ ID NO: 446 - protein, 964 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYASGETGSSGEGTGSTGSGAGESDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 447 - protein, 982 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYASGETGSSGEGTGSTGSGAGESDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 448 - protein, 963 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYASGETGSSGEGTGSTGSGAGESDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 449 - protein, 981 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYASGETGSSGEGTGSTGSGAGESDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 450 - protein, 974 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYASGETGSSGEGTGSTGSGAGESGTGESGEGGSDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQERSPSYAS

SEQ ID NO: 451 - protein, 992 aa, Artificial
  Synthetic sequence
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYASGETGSSGEGTGSTGSGAGESGTGESGEGGSDAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPAPPEPPGILAPQPPDVGSSDPLSMVGPSQGRSPSYAS

SEQ ID NO: 452 - protein, 272 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 453 - protein, 275 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 454 - protein, 280 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQEEEEDEEEEDHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 455 - protein, 280 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 456 - protein, 282 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGSHHHHHHHHGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 457 - protein, 285 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 458 - protein, 285 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 459 - protein, 286 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGSGSGSGSGSGSGSGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 460 - protein, 288 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSTPPTPSPSTPPTPSPSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 461 - protein, 293 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQRGGEEKKKEKEKEEQEERETKTPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 462 - protein, 295 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQGGGGSGGGGSGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 463 - protein, 300 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPPTPEPPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 464 - protein, 306 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSTPPTPSPSTPPTPSPSPSTPPTPSPSTPPTPSPSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 465 - protein, 275 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 466 - protein, 290 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 467 - protein, 310 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPPTPEPPSPEPPTPEPPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 468 - protein, 290 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPTPEPPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 469 - protein, 284 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPGGGSPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 470 - protein, 284 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPEEEDPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 471 - protein, 294 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPPTPEPEEEDPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 472 - protein, 304 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPTPEPPSPEPPTPEPEEEDPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 473 - protein, 305 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPTPEPPSPEPPTPEPGGGGSPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 474 - protein, 296 aa, Artificial
  Synthetic sequence
GVSDVPRDLEVVAATPTSLLISWHSYYEQNSYYRITYGETGGNSPVQEFTVPYSQTTATISGLKPGVDYTITVYAVYGSKYYYPISINYRTEIEKPSQPSPEPTPEPSPEPPTPEPSPEPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 475 - protein, 414 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 476 - protein, 427 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSGGGGGSGGGSGGGGSGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 477 - protein, 429 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKPSPEPPTPEPPSPEPPTPEPPSPEPPTPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 478 - protein, 414 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKPSPEPPTPEPPSPEPHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 479 - protein, 411 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSHHHHHHHHGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 480 - protein, 416 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQEGELEHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 481 - protein, 415 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGSSGGGGSGGGSGGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 482 - protein, 414 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 483 - protein, 412 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 484 - protein, 413 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYA

SEQ ID NO: 485 - protein, 411 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPS

SEQ ID NO: 486 - protein, 419 aa, Artificial
  Synthetic sequence
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 487 - protein, 414 aa, Artificial
  Synthetic sequence
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGSGGGSGGGGSHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLGSGRGPARFLPLPGLPPAPPEPPGILAPQPPDVGSSDPLSMVEPSQGRSPSYAS

SEQ ID NO: 488 - protein, 108 aa, Artificial
  FGF-21 Fragment
MHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVY

SEQ ID NO: 489 - protein, 19 aa, Artificial
  FGF-21 Fragment
PGILAPQPPDVGSSDPLSM

SEQ ID NO: 490 - protein, 9 aa, Artificial
  Purification tag
HHHHHHSGG

SEQ ID NO: 491 - protein, 8 aa, Artificial
  FLAG Tag
DYKDDDDK

SEQ ID NO: 492 - protein, 41 aa, Artificial
  Modified FGF-21 Polypeptide Fragment
SEAHGLPLHLPGNKSPHRDPAPRGPARFLPLPGLPPAPPEP

SEQ ID NO: 493 - protein, 32 aa, Artificial
  Modified FGF-21 Polypeptide Fragment
SEAHGLPLHLGSGRGPARFLPLPGLPPAPPEP

SEQ ID NO: 494 - protein, 41 aa, Artificial; identical to SEQ ID NO: 492
  Modified FGF-21 Polypeptide Fragment

SEQ ID NO: 495 - protein, 41 aa, Artificial
  Modified FGF-21 Polypeptide Fragment
SEAHGLPLHLPGKKSPHRDPAPRGPARFLPLPGLPPAPPEP

SEQ ID NO: 496 - protein, 39 aa, Artificial
  Modified FGF-21 Polypeptide Fragment
SEAHGLPLHLPGDKSRDPAPRGPARFLPLPGLPPAPPEP

SEQ ID NO: 497 - protein, 39 aa, Artificial
  Modified FGF-21 Polypeptide Fragment
SEAHGLPLHLPGHKSRDPAPRGPARFLPLPGLPPAPPEP

SEQ ID NO: 498 - protein, 41 aa, Artificial
  Modified FGF-21 Polypeptide Fragment
SEAHGLPLHLPGDKSPHRDPAPRGPARFLPLPGLPPAPPEP

SEQ ID NO: 499 - protein, 29 aa, Artificial
  Modified FGF-21 Polypeptide Fragment
SEAHGLPLHLGSGARFLPLPGLPPAPPEP

SEQ ID NO: 500 - protein, 41 aa, Artificial
  Modified FGF-21 Polypeptide Fragment
SEAHGLPLHLPGQKSPHRDPAPRGPARFLPLPGLPPAPPEP

SEQ ID NO: 501 - protein, 31 aa, Artificial
  Modified FGF-21 Polypeptide Fragment
SEAHGLPLHLGSGGPARFLPLPGLPPAPPEP

SEQ ID NO: 502 - protein, 38 aa, Artificial
  Modified FGF-21 Polypeptide Fragment
SEAHGLPLHLGSGHRDPAPRGPARFLPLPGLPPAPPEP

SEQ ID NO: 503 - protein, 39 aa, Artificial
  Modified FGF-21 Polypeptide Fragment
SEAHGLPLHLPHHSGRDPAPRGPARFLPLPGLPPAPPEP

SEQ ID NO: 504 - protein, 39 aa, Artificial
  Modified FGF-21 Polypeptide Fragment
SEAHGLPLHLPGKDSQDPAPRGPARFLPLPGLPPAPPEP

SEQ ID NO: 505 - protein, 39 aa, Artificial; identical to SEQ ID NO: 497
  Modified FGF-21 Polypeptide Fragment

SEQ ID NO: 506 - protein, 39 aa, Artificial; identical to SEQ ID NO: 497
  Modified FGF-21 Polypeptide Fragment

SEQ ID NO: 507 - protein, 39 aa, Artificial; identical to SEQ ID NO: 497
  Modified FGF-21 Polypeptide Fragment

SEQ ID NO: 508 - protein, 39 aa, Artificial; identical to SEQ ID NO: 497
  Modified FGF-21 Polypeptide Fragment

SEQ ID NO: 509 - protein, 41 aa, Artificial; identical to SEQ ID NO: 492
  Modified FGF-21 Polypeptide Fragment

SEQ ID NO: 510 - protein, 39 aa, Artificial
  Modified FGF-21 Polypeptide Fragment
SEAHGLPLHLGSGPHRDPAPRGPARFLPLPGLPPAPPEP

SEQ ID NO: 511 - protein, 37 aa, Artificial
  Modified FGF-21 Polypeptide Fragment
SEAHGLPLHLGGHRDPAPRGPARFLPLPGLPPAPPEP

SEQ ID NO: 512 - protein, 37 aa, Artificial
  Modified FGF-21 Polypeptide Fragment
SEAHGLPLHLGSGRDPAPRGPARFLPLPGLPPAPPEP

SEQ ID NO: 513 - protein, 35 aa, Artificial
  Modified FGF-21 Polypeptide Fragment
SEAHGLPLHLSGGPAPRGPARFLPLPGLPPAPPEP

SEQ ID NO: 514 - protein, 30 aa, Artificial
  Modified FGF-21 Polypeptide Fragment
SEAHGLPLHLGGGPARFLPLPGLPPAPPEP

SEQ ID NO: 515 - protein, 13 aa, Artificial
  Modified FGF-21 Polypeptide Fragment
VGPSQGRSPSYAS

SEQ ID NO: 516 - protein, 13 aa, Artificial
  Modified FGF-21 Polypeptide Fragment
VEPSQGRSPSYAS

SEQ ID NO: 517 - protein, 13 aa, Artificial
  Modified FGF-21 Polypeptide Fragment
VEPSQGRSPSYAS

SEQ ID NO: 518 - protein, 13 aa, Artificial
  Modified FGF-21 Polypeptide Fragment
VEPSQGRSPSYAS

SEQ ID NO: 519 - protein, 13 aa, Artificial
  Modified FGF-21 Polypeptide Fragment
VEPSQGRSPSYAS

SEQ ID NO: 520 - protein, 13 aa, Artificial
  Modified FGF-21 Polypeptide Fragment
VEPSQGRSPSYAS

SEQ ID NO: 521 - protein, 13 aa, Artificial
  Modified FGF-21 Polypeptide Fragment
VEPSQGRSPSYAS

SEQ ID NO: 522 - protein, 13 aa, Artificial
  Modified FGF-21 Polypeptide Fragment
VEPSQGRSPSYAS

SEQ ID NO: 523 - protein, 13 aa, Artificial
  Modified FGF-21 Polypeptide Fragment
VEPSQGRSPSYAS

SEQ ID NO: 524 - protein, 13 aa, Artificial
  Modified FGF-21 Polypeptide Fragment
VEPSQGRSPSYAS

SEQ ID NO: 525 - protein, 13 aa, Artificial
  Modified FGF-21 Polypeptide Fragment
VEPSQGRSPSYAS

SEQ ID NO: 526 - protein, 13 aa, Artificial
  Modified FGF-21 Polypeptide Fragment
VEPSQGRSPSYAS

SEQ ID NO: 527 - protein, 13 aa, Artificial
  Modified FGF-21 Polypeptide Fragment
VEPSQGRSPSYAS

SEQ ID NO: 528 - protein, 13 aa, Artificial
  Modified FGF-21 Polypeptide Fragment
VGPSQGRSPSYAS

SEQ ID NO: 529 - protein, 13 aa, Artificial
  Modified FGF-21 Polypeptide Fragment
VEPSQGREPSYAS

SEQ ID NO: 530 - protein, 12 aa, Artificial
  Modified FGF-21 Polypeptide Fragment
VPSQGRSPSYAS

SEQ ID NO: 531 - protein, 12 aa, Artificial
  Modified FGF-21 Polypeptide Fragment
VGSQGRSPSYAS

SEQ ID NO: 532 - protein, 3 aa, Artificial
  Modified FGF-21 Polypeptide Fragment
VEP

SEQ ID NO: 533 - protein, 13 aa, Artificial
  Modified FGF-21 Polypeptide Fragment
VEPSQGRSPSYAS

SEQ ID NO: 534 - protein, 13 aa, Artificial
  Modified FGF-21 Polypeptide Fragment
VEPSQGRSPSYAS

SEQ ID NO: 535 - protein, 13 aa, Artificial
  Modified FGF-21 Polypeptide Fragment
VEPSQGRSPSYAS

SEQ ID NO: 536 - protein, 13 aa, Artificial
  Modified FGF-21 Polypeptide Fragment
VEPSQGRSPSYAS

SEQ ID NO: 537 - protein, 13 aa, Artificial
  Modified FGF-21 Polypeptide Fragment
VEPSQGRSPSYAS

SEQ ID NO: 538 - protein, 28 aa, Artificial
  Modified FGF-21 Polypeptide Fragment
SEAHGLPLHLPGGRFLPLPGLPPAPPEP

SEQ ID NO: 539 - protein, 29 aa, Artificial
  Modified FGF-21 Polypeptide Fragment
SEAHGLPLHLPSGGRFLPLPGLPPAPPEP

SEQ ID NO: 540 - protein, 34 aa, Artificial
  Modified FGF-21 Polypeptide Fragment
SEAHGLPLHSGGPAPRGPARFLPLPGLPPAPPEP

SEQ ID NO: 541 - protein, 30 aa, Artificial
  Modified FGF-21 Polypeptide Fragment
SEAHGLPLHGSGGPARFLPLPGLPPAPPEP

SEQ ID NO: 542 - protein, 25 aa, Artificial
  Modified FGF-21 Polypeptide Fragment
SEAHGLPHGGRFLPLPGLPPAPPEP

SEQ ID NO: 543 - protein, 26 aa, Artificial
  Modified FGF-21 Polypeptide Fragment
SEAHGLPHSGGRFLPLPGLPPAPPEP

SEQ ID NO: 544 - protein, 26 aa, Artificial
  Modified FGF-21 Polypeptide Fragment
SEAHGLPHGSGRFLPLPGLPPAPPEP

SEQ ID NO: 545 - protein, 31 aa, Artificial; identical to SEQ ID NO: 501
  Modified FGF-21 Polypeptide Fragment

SEQ ID NO: 546 - protein, 41 aa, Artificial
  Modified FGF-21 Polypeptide Fragment
SEAHGLPLHLPGNKSPHRDPAPRGPARFLPLPGLPPALPEP

SEQ ID NO: 547 - protein, 41 aa, Artificial; identical to SEQ ID NO: 492
  Modified FGF-21 Polypeptide Fragment

SEQ ID NO: 548 - protein, 32 aa, Artificial; identical to SEQ ID NO: 493
  Modified FGF-21 Polypeptide Fragment

SEQ ID NO: 549 - protein, 39 aa, Artificial; identical to SEQ ID NO: 496
  Modified FGF-21 Polypeptide Fragment

SEQ ID NO: 550 - protein, 39 aa, Artificial; identical to SEQ ID NO: 497
  Modified FGF-21 Polypeptide Fragment

SEQ ID NO: 551 - protein, 31 aa, Artificial; identical to SEQ ID NO: 501
  Modified FGF-21 Polypeptide Fragment

SEQ ID NO: 552 - protein, 38 aa, Artificial; identical to SEQ ID NO: 502
  Modified FGF-21 Polypeptide Fragment

SEQ ID NO: 553 - protein, 39 aa, Artificial; identical to SEQ ID NO: 503
  Modified FGF-21 Polypeptide Fragment

SEQ ID NO: 554 - protein, 39 aa, Artificial; identical to SEQ ID NO: 510
  Modified FGF-21 Polypeptide Fragment

SEQ ID NO: 555 - protein, 37 aa, Artificial; identical to SEQ ID NO: 511
  Modified FGF-21 Polypeptide Fragment

SEQ ID NO: 556 - protein, 37 aa, Artificial; identical to SEQ ID NO: 512
  Modified FGF-21 Polypeptide Fragment

SEQ ID NO: 557 - protein, 35 aa, Artificial; identical to SEQ ID NO: 513
  Modified FGF-21 Polypeptide Fragment

SEQ ID NO: 558 - protein, 30 aa, Artificial; identical to SEQ ID NO: 514
  Modified FGF-21 Polypeptide Fragment

SEQ ID NO: 559 - protein, 13 aa, Artificial
  Modified FGF-21 Polypeptide Fragment
VEPSQGRSPSYAS

SEQ ID NO: 560 - protein, 13 aa, Artificial
  Modified FGF-21 Polypeptide Fragment
VEPSQGRSPSYAS

SEQ ID NO: 561 - protein, 13 aa, Artificial
  Modified FGF-21 Polypeptide Fragment
VEPSQGRSPSYAS

SEQ ID NO: 562 - protein, 13 aa, Artificial
  Modified FGF-21 Polypeptide Fragment
VEPSQGRSPSYAS

SEQ ID NO: 563 - protein, 13 aa, Artificial
  Modified FGF-21 Polypeptide Fragment
VEPSQGRSPSYAS

SEQ ID NO: 564 - protein, 13 aa, Artificial
  Modified FGF-21 Polypeptide Fragment
VEPSQGRSPSYAS

SEQ ID NO: 565 - protein, 13 aa, Artificial
  Modified FGF-21 Polypeptide Fragment
VEPSQGRSPSYAS

SEQ ID NO: 566 - protein, 13 aa, Artificial
  Modified FGF-21 Polypeptide Fragment
VTPSQGRSPSYAS

SEQ ID NO: 567 - protein, 13 aa, Artificial
  Modified FGF-21 Polypeptide Fragment
VGPSQGRSPSYAS

SEQ ID NO: 568 - protein, 13 aa, Artificial
  Modified FGF-21 Polypeptide Fragment
VGPSQGRSPSYAS

SEQ ID NO: 569 - protein, 13 aa, Artificial
  Modified FGF-21 Polypeptide Fragment
VEPSQGRSPSYAS

SEQ ID NO: 570 - protein, 13 aa, Artificial
  Modified FGF-21 Polypeptide Fragment
VEPSQGRSPSYAS

SEQ ID NO: 571 - protein, 13 aa, Artificial
  Modified FGF-21 Polypeptide Fragment
VEPSQGRSPSYAS

SEQ ID NO: 572 - protein, 13 aa, Artificial
  Modified FGF-21 Polypeptide Fragment
VEPSQGRSPSYAS

SEQ ID NO: 573 - protein, 13 aa, Artificial
  Modified FGF-21 Polypeptide Fragment
VEPSQGRSPSYAS

SEQ ID NO: 574 - protein, 13 aa, Artificial
  Modified FGF-21 Polypeptide Fragment
VEPSQGRSPSYAS

SEQ ID NO: 575 - protein, 13 aa, Artificial
  Modified FGF-21 Polypeptide Fragment
VEPSQGRSPSYAS

SEQ ID NO: 576 - protein, 13 aa, Artificial
  Modified FGF-21 Polypeptide Fragment
VEPSQGRSPSYAS

SEQ ID NO: 577 - protein, 13 aa, Artificial
  Modified FGF-21 Polypeptide Fragment
VEPSQGRSPSYAS

SEQ ID NO: 578 - protein, 13 aa, Artificial
  Modified FGF-21 Polypeptide Fragment
VEPSQGRSPSYAS

SEQ ID NO: 579 - protein, 13 aa, Artificial
  Modified FGF-21 Polypeptide Fragment
VEPSQGRSPSYAS

What is claimed is:

1. A modified FGF-21 polypeptide comprising a polypeptide having an amino acid sequence having at least 98% amino acid sequence identity to SEQ ID NO: 102.

2. The modified FGF-21 polypeptide of claim 1, wherein said amino acid sequence comprises at least one non-naturally encoded amino acid.

3. The modified FGF-21 polypeptide of claim 2, wherein said at least one non-naturally encoded amino acid comprises a phenylalanine derivative.

4. The modified FGF-21 polypeptide of claim 3, wherein said at least one non-naturally encoded amino acid comprises para-acetyl-L-phenylalanine.

5. The modified FGF-21 polypeptide of claim 4, wherein said amino acid sequence comprises para-acetyl-L-phenylalanine at a position corresponding to amino acid 109 in SEQ ID NO: 102 which corresponds to amino acid 108 in SEQ ID NO: 1.

6. The modified FGF-21 polypeptide of claim 2, wherein said at least one non-naturally encoded amino acid is linked to a half-life extending moiety.

7. The modified FGF-21 polypeptide of claim 6, wherein said half-life extending moiety comprises a poly(ethylene glycol).

8. The modified FGF-21 polypeptide of claim 7, wherein said poly(ethylene glycol) has an average molecular weight of about 30 kDa.

9. The modified FGF-21 polypeptide of claim 1, wherein said amino acid sequence comprises at least one non-naturally encoded amino acid at a position corresponding to amino acid 109 in SEQ ID NO: 102 which corresponds to amino acid 108 in SEQ ID NO: 1.

10. The modified FGF-21 polypeptide of claim 1, wherein said amino acid sequence has at least 99% amino acid sequence identity to SEQ ID NO: 102.

11. The modified FGF-21 polypeptide of claim 1, wherein said modified FGF-21 polypeptide sequence is fused to a fusion partner.

12. The modified FGF-21 polypeptide of claim 11, wherein the fusion partner comprises an Fc domain or fragment thereof.

13. A composition comprising the modified FGF-21 polypeptide of claim 1 and a pharmaceutically acceptable carrier or excipient.

14. A modified FGF-21 polypeptide comprising a polypeptide having the amino acid sequence of SEQ ID NO: 202.

15. The modified FGF-21 polypeptide of claim 14, wherein said modified FGF-21 polypeptide is linked to a half-life extending moiety.

16. The modified FGF-21 polypeptide of claim 15, wherein said half-life extending moiety comprises a poly(ethylene glycol).

17. The modified FGF-21 polypeptide of claim 16, wherein said poly(ethylene glycol) has an average molecular weight of about 30 kDa.

18. A composition comprising the modified FGF-21 polypeptide of claim 14 and a pharmaceutically acceptable carrier or excipient.

19. A modified FGF-21 polypeptide comprising a polypeptide having the amino acid sequence of SEQ ID NO: 202, wherein the para-acetyl-L-phenylalanine in SEQ ID NO: 202 is linked to a poly(ethylene glycol) having an average molecular weight of about 30 kDa.

20. A composition comprising the modified FGF-21 polypeptide of claim 19 and a pharmaceutically acceptable carrier or excipient.

* * * * *